US010251944B2

(12) United States Patent
Binder et al.

(10) Patent No.: US 10,251,944 B2
(45) Date of Patent: Apr. 9, 2019

(54) CANCER VACCINES

(71) Applicant: Pfizer Inc., New York, NY (US)

(72) Inventors: Joseph John Binder, San Diego, CA (US); Paul Jason Cockle, Encinitas, CA (US); Derek John Falconer, San Diego, CA (US); Siradanahalli Guru, San Diego, CA (US); Karin Ute Jooss, San Diego, CA (US); Marianne Marcela Andrea Martinic, La Jolla, CA (US); Kenneth Nelson Wills, Carlsbad, CA (US); Helen Kim Cho, San Diego, CA (US)

(73) Assignee: Pfizer Inc., New York, NY (US)

( * ) Notice: Subject to any disclaimer, the term of this patent is extended or adjusted under 35 U.S.C. 154(b) by 0 days.

(21) Appl. No.: 15/407,890

(22) Filed: Jan. 17, 2017

(65) Prior Publication Data
US 2017/0202938 A1 Jul. 20, 2017

Related U.S. Application Data

(60) Provisional application No. 62/419,190, filed on Nov. 8, 2016, provisional application No. 62/280,636, filed on Jan. 19, 2016.

(51) Int. Cl.
*A61K 39/00* (2006.01)
*A61K 31/711* (2006.01)
*C12N 15/12* (2006.01)
*C12N 15/62* (2006.01)
*A61K 48/00* (2006.01)

(52) U.S. Cl.
CPC ........ *A61K 39/0011* (2013.01); *A61K 48/005* (2013.01); *A61K 31/711* (2013.01); *A61K 2039/53* (2013.01); *A61K 2039/57* (2013.01); *A61K 2039/575* (2013.01); *A61K 2039/585* (2013.01); *A61K 2039/70* (2013.01); *C12N 15/62* (2013.01)

(58) Field of Classification Search
None
See application file for complete search history.

(56) References Cited

U.S. PATENT DOCUMENTS

| 5,723,318 | A | 3/1998 | Yamaguchi et al. |
| 6,093,809 | A | 7/2000 | Cech et al. |
| 6,153,430 | A | 11/2000 | Pastan et al. |
| 6,261,836 | B1 | 7/2001 | Cech et al. |
| 6,337,200 | B1 | 1/2002 | Morin |
| 6,475,789 | B1 | 11/2002 | Cech et al. |
| 7,056,513 | B2 | 6/2006 | Cech et al. |
| 7,091,021 | B2 | 8/2006 | Morin |
| 7,262,288 | B1 | 8/2007 | Cech et al. |
| 7,375,183 | B1 | 5/2008 | Pastan et al. |
| 7,388,071 | B2 | 6/2008 | Zanetti |
| 7,560,437 | B2 | 7/2009 | Cech et al. |
| 7,622,549 | B2 | 11/2009 | Cech et al. |
| 8,003,773 | B2 | 8/2011 | Langlade-Demoyen et al. |
| 8,362,209 | B2 | 1/2013 | Santos |
| 8,697,836 | B2 | 4/2014 | Zanetti |
| 8,709,995 | B2 | 4/2014 | Cech et al. |
| 8,796,438 | B2 | 8/2014 | Morin |
| 9,155,788 | B2 | 10/2015 | Hoerr et al. |
| 9,296,784 | B2 | 3/2016 | Jaffee et al. |
| 2003/0143228 | A1 | 7/2003 | Chen et al. |
| 2004/0086518 | A1 | 5/2004 | Zanetti |
| 2004/0136963 | A1 | 7/2004 | Wilson et al. |
| 2005/0013825 | A1 | 1/2005 | Cech et al. |
| 2007/0269451 | A1 | 11/2007 | Crowe et al. |
| 2008/0090778 | A1* | 4/2008 | Scarselli ............. C07K 14/245 514/44 R |
| 2008/0171711 | A1 | 7/2008 | Hoerr et al. |
| 2009/0202499 | A1 | 8/2009 | Zanetti |
| 2011/0217332 | A1 | 9/2011 | Colloca et al. |
| 2013/0028915 | A1 | 1/2013 | Palucka et al. |
| 2013/0295110 | A1* | 11/2013 | Binder ............... A61K 39/0011 424/142.1 |
| 2014/0050751 | A1 | 2/2014 | Jaffee et al. |
| 2014/0234351 | A1* | 8/2014 | Bender ................. A61K 45/06 424/185.1 |

(Continued)

FOREIGN PATENT DOCUMENTS

| CN | 101920009 | 12/2010 |
| EP | 1783139 | 5/2007 |
| WO | WO93/10814 | 6/1993 |
| WO | WO9734921 | 9/1997 |
| WO | WO200112342 | 2/2001 |
| WO | WO01/14424 | 3/2001 |
| WO | WO0216555 | 2/2002 |
| WO | WO2003041070 | 5/2003 |
| WO | WO04006837 | 1/2004 |
| WO | WO08145603 | 12/2008 |
| WO | WO2010/005958 | 1/2010 |

(Continued)

OTHER PUBLICATIONS

Teresa Gilewski et al. Vaccination of high-risk Breast Cancer Patients with Mucin-1 (MUC1) Keyhole Limpet Hemocyanin Conjugate plus QS-21. Clinical Cancer Research, vol. 6, 1693-1701 (May 2000).

(Continued)

*Primary Examiner* — Hong Sang
(74) *Attorney, Agent, or Firm* — Austin W. Zhang

(57) ABSTRACT

The present disclosure provides (i) isolated immunogenic TAA polypeptides (i.e., an immunogenic MUC1 polypeptides, an immunogenic MSLN polypeptides, and an immunogenic TERT polypeptides), (ii) isolated nucleic acid molecules encoding one or more immunogenic TAA polypeptides, (iii) compositions comprising an immunogenic TAA polypeptide or an isolated nucleic acid molecule encoding an immunogenic TAA polypeptide, and (iv) methods relating to uses of the polypeptides, nucleic acid molecules, and compositions.

42 Claims, No Drawings
Specification includes a Sequence Listing.

(56) References Cited

U.S. PATENT DOCUMENTS

| 2014/0335050 | A1* | 11/2014 | Haggerty | A61K 39/395 424/85.5 |
|---|---|---|---|---|
| 2015/0030633 | A1 | 1/2015 | Hoerr et al. | |
| 2016/0030536 | A1 | 2/2016 | Weiner et al. | |

FOREIGN PATENT DOCUMENTS

| WO | WO2010/086189 | 8/2010 |
|---|---|---|
| WO | WO 2013/025972 | 2/2013 |
| WO | WO2015/063647 | 5/2015 |
| WO | WO2015/173764 | 11/2015 |

OTHER PUBLICATIONS

International Search Report, PCT/IB2017/050229, dated Jan. 16, 2017.

Bochkov, Y. A., et al., "Translational efficiency of EMCV IRES in bicistronic vectors is dependent upon IRES sequence and gene location," Biotechniques, 2006, 283-292, 41(3).

Bonnal, S., et al., "IRESdb: the Internal Ribosome Entry Site database," Nucleic Acids Res, 2003, 427-428, 31(1).

De Felipe, P., et al., "E unum pluribus: multiple proteins from a self-processing polyprotein," Trends Biotechnol, 2006, 68-75, 24(2).

Fang, J., et al., "An antibody delivery system for regulated expression of therapeutic levels of monoclonal antibodies in vivo," Mol Ther, 2007, 1153-1159, 15(6).

Huang, Y., et al., "Design, construction, and characterization of a dual-promoter multigenic DNA vaccine directed against an HIV-1 subtype C/B' recombinant," J Acquired Immune Deficiency Syndrome, 2008, 403-411, 47(4).

Ibrahimi, A., et al., "Highly efficient multicistronic lentiviral vectors with peptide 2A sequences," Hum Gene Ther, 2009, 845-860, 20(8).

Kim, J. H., et al., "High cleavage efficiency of a 2A peptide derived from porcine teschovirus-1 in human cell lines, zebrafish and mice," PLoS One, 2011, 6(4): e18556.

Luke, G., et al., "Occurrence, function and evolutionary origins of '2A-like' sequences in virus genomes," J Gen Virol, 2008, 1036-1042, 89(Pt 4).

Szymczak, A. L., et al., "Development of 2A peptide-based strategies in the design of multicistronic vectors," Expert Opin Biol Ther, 2005, 627-638, 5(5).

Xu, K., et al., "Broad humoral and cellular immunity elicited by a bivalent DNA vaccine encoding HA and NP genes from an H5N1 virus," Viral Immunol, 2011, 45-56, 24(1).

Furukawa, K., et al., "Abstract 2512: Novel immunotherapy using a tumor lysate vaccine with a-gal epitopes against pancreatic cancer", AACR 106th Annual Meeting, 2015, Suppl 2512. vol. 75, Issue 15.

Tanida, T., et al., "Pancreatic cancer immunotherapy using a tumor lysate vaccine, engineered to express a-gal epitopes, targets pancreatic cancer stem cells", International Journal of Oncology, 2015, pp. 78-90, vol. 46.

* cited by examiner

CANCER VACCINES

REFERENCE TO RELATED APPLICATIONS

This application claims priority to U.S. Provisional Application No. 62/280,636 filed Jan. 19, 2016 and U.S. Provisional Application No. 62/419,190 filed Nov. 8, 2016. The entire content of each of the foregoing applications is incorporated herein by reference.

REFERENCE TO SEQUENCE LISTING

This application is being filed along with a sequence listing in electronic format. The sequence listing is provided as a file in .txt format entitled "PC71855A_SeqList_Corrected_ST25.txt", created on Jan. 2, 2019 November 12, 2018, and having a size of 755 KB. The sequence listing contained in the .txt file is part of the specification and is herein incorporated by reference in its entity.

FIELD OF THE INVENTION

The present invention relates generally to immunotherapy and specifically to vaccines and methods for treating or preventing neoplastic disorders.

BACKGROUND OF THE INVENTION

Cancers are a leading cause of mortality worldwide. They may occur in a variety of organs, such as pancreas, ovaries, breasts, lung, colon, and rectum. Pancreatic cancers are the fourth most common cause of cancer deaths in the United States. Pancreatic cancers may occur in the exocrine or endocrine component of the pancreas. Exocrine cancers include (1) pancreatic adenocarcinoma, which is by far the most common type, (2) acinar cell carcinoma, which represents 5% of exocrine pancreatic cancers, (3) cystadenocarcinomas, which account for 1% of pancreatic cancers, and (4) other rare forms of cancers, such as pancreatoblastoma, adenosquamous carcinomas, signet ring cell carcinomas, hepatoid carcinomas, colloid carcinomas, undifferentiated carcinomas, and undifferentiated carcinomas with osteoclast-like giant cells.

Ovarian cancer accounts for about 3% of cancers among women, but it causes more deaths than any other cancer of the female reproductive system. Ovarian cancers include (1) epithelial cancers, such as epithelial ovarian carcinomas, (2) germ cell cancers, such as immature teratomas, and (3) stromal cancers, such as granulosa cell tumors.

Breast cancer is the second most common cancer among American women and the second leading cause of cancer death in women. Breast cancers can be classified based on the hormone receptors and HER2/neu status, such as (1) hormone receptor-positive cancers (where the cancer cells contain either estrogen receptors or progesterone receptors), (2) hormone receptor-negative cancers (where the cancer cells don't have either estrogen or progesterone receptors), (3) HER2/neu positive (wherein cancers that have excessive HER2/neu protein or extra copies of the HER2/neu gene), (4) HER2/neu negative cancers (where the cancers don't have excess HER2/neu), (5) triple-negative cancers (wherein the breast cancer cells have neither estrogen receptors, nor progesterone receptors, nor excessive HER2), and (6) triple-positive cancers (where the cancers are estrogen receptor-positive, progesterone receptor-positive, and have too much HER2).

Lung cancer accounts for more than a quarter of all cancer deaths and is by far the leading cause of cancer death among both men and women. The most common type of lung cancers is non-small cell lung cancers (NSCLC), which account for about 85% to 90% of lung cancers. NSCLC may be further classified into several subtypes, such as squamous cell (epidermoid) carcinoma, adenocarcinoma, large cell (undifferentiated) carcinoma, adenosquamous carcinoma, and sarcomatoid carcinoma. The second common type of lung cancer is small cell lung cancer (SCLC), which accounts for about 10% to 15% of all lung cancers.

Colorectal cancer (CRC) is the second leading cause of cancer-related deaths in the United States when both men and women are combined. Adenocarcinoma is the most common type of CRC, which accounts for more than 95% of colorectal cancers. Other less common types of CRC include Carcinoid tumors, gastrointestinal stromal tumors (GISTs), lymphomas, and sarcomas.

Gastric cancer is the third most common cause of cancer-related death in the world. It remains difficult to cure, primarily because most patients present with advanced disease. In the United States, gastric cancer is currently the $15^{th}$ most common cancer. About 90-95% of gastric cancers are adenocarcinomas; other less common types include lymphoma (4%), GISTs, and carcinoid tumors (3%).

Traditional regimens of cancer management have been successful in the management of a selective group of circulating and solid cancers. However, many types of cancers are resistant to traditional approaches. In recent years, immunotherapy for cancers has been explored, particularly cancer vaccines and antibody therapies. One approach of cancer immunotherapy involves the administering an immunogen to generate an active systemic immune response towards a tumor-associated antigen (TAA) on the target cancer cell. While a large number of tumor-associated antigens have been identified and many of these antigens have been explored as viral-, bacterial-, protein-, peptide-, or DNA-based vaccines for the treatment or prevention of cancers, most clinical trials so far have failed to produce a therapeutic product. Therefore, there exists a need for immunogens that may be used in the treatment or prevention of cancers.

The present disclosure relates to immunogens derived from the tumor-associated antigens MUC1, mesothelin, and TERT, nucleic acid molecules encoding the immunogens, and compositions comprising such immunogens or nucleic acids.

The human mucin 1 (MUC1; also known as episialin, PEM, H23Ag, EMA, CA15-3, and MCA) is a polymorphic transmembrane glycoprotein expressed on the apical surfaces of simple and glandular epithelia. The MUC1 gene encodes a single polypeptide chain precursor that includes a signal peptide sequence. Immediately after translation the signal peptide sequence is removed and the remaining portion of the MUC1 precursor is further cleaved into two peptide fragments: the longer N-terminal subunit (MUC1-N or MUC1a) and the shorter C-terminal subunit (MUC1-C or MUC16). The mature MUC1 comprises a MUC1-N and a MUC1-C associated through stable hydrogen bonds. MUC1-N, which is an extracellular domain, contains 25 to 125 variable number tandem repeats (VNTR) of 20 amino acid residues. MUC1-C contains a short extracellular region (approximately 53 amino acids), a transmembrane domain (approximately 28 amino acid), and a cytoplasmic tail (approximately 72 amino acids). The cytoplasmic tail of MUC1 (MUC1-CT) contains highly conserved serine and tyrosine residues that are phosphorylated by growth factor receptors and intracellular kinases. Human MUC1 exists in multiple isoforms resulting from different types of MUC1 RNA alternative splicing. The amino acid sequence of full length human MUC1 isoform 1 protein precursor (isoform 1, Uniprot P15941-1) is provided in SEQ ID NO: 1 ("MUC1 Isoform 1 Reference Polypeptide"). At least 16 other isoforms of human MUC-1 have been reported so far (Uniprot P15941-2 through P15941-17), which include various insertions, deletions, or substitutions as compared to the sequence of isoform 1. These isoforms are known as isoform 2, 3, 4, 5, 6, Y, 8, 9, F, Y-LSP, S2, M6, ZD, T10, E2, and J13 (Uniprot P15941-2 through P15941-17, respectively). The full length human MUC1 isoform 1 precursor protein consists of 1255 amino acids, which includes a signal peptide sequence at amino acids 1-23. The MUC1-N and MUC1-C domains of the mature MUC1 protein consist of amino acids 24-1097 and 1098-1255, respectively.

Mesothelin (also known as MSLN) is a membrane-bound glycoprotein present on the surface of cells lining the pleura, peritoneum and pericardium, and is overexpressed in several human tumors, including mesothelioma, ovarian, and pancreatic adenocarcinoma. The Mesothelin gene encodes a 71-kilodalton (kDa) precursor protein that is processed to a 40-kDa Mesothelin protein and a secreted megakaryocyte potentiating factor (MPF) protein (Chang, et al, Proc Natl Acad Sci USA (1996) 93:136-40). Alternative splicing of MSLN gene results in at least four mesothelin isoforms. The amino acid sequences of isoform 1 (Uniprot Q13421-1), isoform 2 (Uniprot Q13421-3), isoform 3 (Uniprot Q13421-2), and isoform 4 (Uniprot Q13421-4) are available at Uniprot. The amino acid sequence of full length human MSLN isoform 2 precursor protein (Uniprot identifier Q13421-3), which consists of 622 amino acids, is provided in SEQ ID NO:2 ("Mesothelin Precursor Isoform 2 Reference Polypeptide"). The cytoplasmic portion of MSLN comprises amino acid residues 37 to 597 of SEQ ID NO:2 Isoform 2 is the major form of MSLN. Isoform 1, which consists of 630 amino acids, differs from isoform 2 by having an insertion of 8 amino acids (PQAPRRPL) at position 409 of the isoform 2 sequence. Isoform 3 has an alternative C terminus (at positions 593-622 of isoform 2) while isoform 4 has a deletion of amino acid 44, as compared with isoform 2. Isoform 2 is initially translated as a 622-amino acid precursor, which comprises a signal peptide sequence (amino acids 1-36) at the N-terminus and a GPI-anchor sequence at the C-terminus. The signal peptide sequence and the GPI-anchor sequence may be cleaved off in the mature mesothelin.

Telomerase reverse transcriptase (or TERT) is the catalytic component of the telomerase, which is a ribonucleoprotein polymerase responsible for maintaining telomere ends by addition of the telomere repeat TTAGGG. In addition to TERT, telomerase also includes an RNA component which serves as a template for the telomere repeat. Human TERT gene encodes an 1132 amino acid protein. Several isoforms of human TERT exist, which result from alternative splicing. The amino acid sequences of isoform 1, isoform 2, isoform 3, and isoform 4 are available at Uniprot (Uniprot identifiers 014746-1, 014746-2, 014746-3, and 014746-4, respectively). The amino acid sequence of human full length TERT isoform 1 protein (isoform 1, Genbank AAD30037, Uniprot 014746-1) is also provided herein in SEQ ID NO:3 ("TERT Isoform 1 Reference Polypeptide"). As compared with TERT isoform 1 (014746-1), isoform 2 (014746-2) has replacement of amino acids 764-807 (STLTDLQPYM (SEQ ID NO:622) . . . LNEASSGLFD (SEQ ID NO:623)→LRPVPGDPAG (SEQ ID NO:624) . . . AGRAAPAFGG (SEQ ID NO:625)), isoform 3 (014746-3) has deletion of amino acids 885-947, and isoform 4 (014746-4) has deletions of amino acids 711-722 and 808-1132, and replacement of amino acids 764-807 (STLTDLQPYM (SEQ ID NO:626) . . . LNEASSGLFD (SEQ ID NO:627)→LRPVPGDPAG (SEQ ID NO:628) . . . AGRAAPAFGG 9SEQ ID NO:629)).

SUMMARY OF THE INVENTION

In some aspects, the present disclosure provides isolated immunogenic polypeptides which comprise amino acid sequences of one or more human TAA selected from MUC1, MSLN, and TERT. The immunogenic polypeptides are useful, for example, in eliciting an immune response in vivo in a subject or for use as a component in vaccines for treating cancer.

In other aspects, the present disclosure provides nucleic acid molecules that encode an immunogenic polypeptide provided by the present disclosure. In some embodiments, the present disclosure provides multi-antigen nucleic acid constructs that each encode two, three, or more immunogenic polypeptides.

The disclosure also provides vectors containing one or more nucleic acid molecules of the invention. The vectors are useful for cloning or expressing the immunogenic TAA polypeptides encoded by the nucleic acid molecules, or for delivering the nucleic acid molecules in a composition, such as a vaccine, to a host cell or to a host animal or a human.

In some further aspects, the present disclosure provides compositions comprising one or more immunogenic TAA polypeptides, isolated nucleic acid molecules encoding immunogenic TAA polypeptides, or vectors or plasmids containing nucleic acid molecules encoding immunogenic TAA polypeptides. In some embodiments, the composition is an immunogenic composition useful for eliciting an immune response against a TAA in a subject, such as a mouse, dog, monkey, or human. In some embodiments, the composition is a vaccine composition useful for immunization of a mammal, such as a human, for inhibiting abnormal cell proliferation, for providing protection against the development of cancer (used as a prophylactic), or for treatment of disorders (used as a therapeutic) associated with TAA over-expression, such as cancer, particularly pancreatic, ovarian, and triple-negative breast cancer. In still other aspects, the present disclosure provides methods of using the immunogenic TAA polypeptides, isolated nucleic acid molecules, and compositions comprising an immunogenic TAA polypeptide or isolated nucleic acid molecules described herein above. In some embodiments, the present disclosure provides a method of eliciting an immune response against a TAA in a subject, particularly a human, comprising administering to the subject an effective amount of a polypeptide provided by the invention that is immunogenic against the target TAA, an effective amount of an isolated nucleic acid molecule encoding such an immunogenic polypeptide, or a composition comprising such an immunogenic TAA polypeptide or an isolated nucleic acid molecule encoding such an immunogenic TAA polypeptide. The polypeptides, nucleic acids, or compositions comprising the polypeptide or nucleic acid may be used together with one or more adjuvants or immune modulators.

DETAILED DESCRIPTION OF THE INVENTION

A. Definitions

The term "adjuvant" refers to a substance that is capable of enhancing, accelerating, or prolonging an immune response elicited by an immunogen.

The term "agonist" refers to a substance which promotes (induces, causes, enhances or increases) the activity of another molecule (such as a receptor). The term "agonist" encompasses substances which bind a receptor and substances which promote receptor function without binding thereto.

The term "antagonist" or "inhibitor" refers to a substance that partially or fully blocks, inhibits, or neutralizes a biological activity of another molecule or a receptor.

The term "co-administration" refers to administration of two or more agents to the same subject during a treatment period. The two or more agents may be encompassed in a single formulation and thus be administered simultaneously. Alternatively, the two or more agents may be in separate physical formulations and administered separately, either sequentially or simultaneously to the subject. The term "administered simultaneously" or "simultaneous administration" means that the administration of the first agent and that of a second agent overlap in time with each other, while the term "administered sequentially" or "sequential administration" means that the administration of the first agent and that of a second agent do not overlap in time with each other.

The term "cytosolic" or "cytoplasmic" means that after a nucleotide sequence encoding a particular polypeptide is expressed by a host cell, the expressed polypeptide is expected to be retained inside the host cell.

The term "degenerate variant" refers to a polynucleotide that differs in the nucleotide sequence from the reference polynucleotide but encodes the same polypeptidesequence as encoded by the reference polynucleotide. Most of the 20 natural amino acids that are components of proteins or peptides are specified by more than one codon. For instance, the codons CGU, CGC, CGA, CGG, AGA, and AGG all encode the amino acid arginine. Thus, at every position where an arginine is specified within a protein-encoding sequence, the codon can be altered to any of the corresponding codons described without altering the amino acid sequence of the encoded protein. Because of the degeneracy of the genetic code, a large number of functionally identical nucleic acids encode any given polypeptide.

The term "effective amount" refers to an amount administered to a subject that is sufficient to cause a desired effect in the subject.

The term "fragment" of a given polypeptide refers to a polypeptide that is shorter than the given polypeptide and shares 100% identity with the sequence of the given polypeptide.

The term "functional variant" of an immunogenic TAA polypeptide refers to a polypeptide that comprises from 90% to 110% of the number of amino acids of the reference immunogenic TAA polypeptide, has lower than 100% but higher than 95% identity to the amino acid sequence of the reference TAA polypeptide, and possess the same or similar immunogenic properties of the reference immunogenic TAA polypeptide.

The term "identical" refers to two or more nucleic acids, or two or more polypeptides, that share the exact same sequence of nucleotides or amino acids, respectively. The term "percent identity" describes the level of similarity between two or more nucleic acids or polypeptides. When two sequences are aligned by bioinformatics software, "percent identity" is calculated by multiplying the number of exact nucleotide/amino acid matches between the sequences by 100, and dividing by the length of the aligned region, including gaps. For example, two 100-amino acid long polypeptides that exhibit 10 mismatches when aligned would be 90% identical.

The term "immune-effector-cell enhancer" or "IEC enhancer" refers to a substance capable of increasing or enhancing the number, quality, and/or function of one or more types of immune effector cells of a subject. Examples of immune effector cells include cytolytic CD8 T cells, CD4 T cells, NK cells, and B cells.

The term "immune modulator" refers to a substance capable of altering (e.g., inhibiting, decreasing, increasing, enhancing or stimulating) the working or function of any component of the innate, humoral, or cellular immune system of a subject. Thus, the term "immune modulator" encompasses the "immune-effector-cell enhancer" as defined herein and the "immune-suppressive-cell inhibitor" as defined herein, as well as substance that affects any other components of the immune system of a subject.

The term "immune response" refers to any detectable response to a particular substance (such as an antigen or immunogen) by the immune system of a host vertebrate animal, including, but not limited to, innate immune responses (e.g., activation of Toll-like receptor signaling cascade), cell-mediated immune responses (e.g., responses mediated by T cells, such as antigen-specific T cells, and non-specific cells of the immune system), and humoral immune responses (e.g., responses mediated by B cells, such as generation and secretion of antibodies into the plasma, lymph, and/or tissue fluids). Examples of immune responses include an alteration (e.g., increase) in Toll-like receptor activation, lymphokine (e.g., cytokine (e.g., Th1, Th2 or Th17 type cytokines) or chemokine) expression or secretion, macrophage activation, dendritic cell activation, T cell (e.g., CD4+ or CD8+ T cell) activation, NK cell activation, B cell activation (e.g., antibody generation and/or secretion), binding of an immunogen (e.g., antigen, immunogenic polypeptide) to an MHC molecule, induction of a cytotoxic T lymphocyte ("CTL") response, induction of a B cell response (e.g., antibody production), and expansion (e.g., growth of a population of cells) of cells of the immune system (e.g., T cells and B cells), and increased processing and presentation of antigen by antigen presenting cells. The term "immune response" also encompasses any detectable response to a particular substance (such as an antigen or immunogen) by one or more components of the immune system of a vertebrate animal in vitro.

The term "immunogen" refers to a substance that is immunogenic.

The term "immunogenic" refers to the ability of a substance upon administration to a subject (such as a human) to cause, elicit, stimulate, or induce an immune response, or to improve, enhance, increase or prolong a pre-existing immune response, against a particular antigen in the subject, whether alone or when linked to a carrier, in the presence or absence of an adjuvant.

The term "immunogenic composition" refers to a composition that is immunogenic.

The term "immunogenic MUC1 polypeptide" refers to a polypeptide that is immunogenic against a human native MUC1 protein or against cells expressing the human native MUC1 protein. The polypeptide may have the same amino acid sequence as that of a human native MUC1 protein or display one or more mutations as compared to the amino acid sequence of a human native MUC1 protein.

The term "immunogenic MSLN polypeptide" refers to a polypeptide that is immunogenic against a human native MSLN protein or against cells expressing human native MSLN protein. The polypeptide may have the same amino acid sequence as that of a human native MSLN protein or displays one or more mutations as compared to the amino acid sequence of a human native MSLN protein.

The term "immunogenic TERT polypeptide" refers to a polypeptide that is immunogenic against a human native TERT protein or against cells expressing a human native TERT protein. The polypeptide may have the same amino acid sequence as that of a human native TERT protein or displays one or more mutations as compared to the amino acid sequence of a human native TERT protein.

The term "immunogenic TAA polypeptide" refers to an "immunogenic MSLN polypeptide," an "immunogenic MUC1 polypeptide, or an "immunogenic TERT polypeptide," each as defined herein above.

The term "immunogenic MUC1 nucleic acid molecule" refers to a nucleic acid molecule that encodes an "immunogenic MUC1 polypeptide" as defined herein.

The term "immunogenic MSLN nucleic acid molecule" refers to a nucleic acid molecule that encodes an "immunogenic MSLN polypeptide" as defined herein.

The term "immunogenic TERT nucleic acid molecule" refers to a nucleic acid molecule that encodes an "immunogenic TERT polypeptide" as defined herein.

The term "immunogenic TAA nucleic acid molecule" refers to a nucleic acid molecule that encodes an "immunogenic MUC1 polypeptide," an "immunogenic MSLN polypeptide, or an "immunogenic TERT polypeptide" as defined herein above.

The term "immune-suppressive-cell inhibitor" or "ISC inhibitor" refers to a substance capable of reducing and/or suppressing the number and/or function of immune suppressive cells of a subject. Examples of immune suppressive cells include regulatory T cells ("Tregs"), myeloid-derived suppressor cells, and tumor-associated macrophages.

The term "subject" refers to either a human or a non-human mammal. The term "mammal" refers to any animal species of the Mammalia class. Examples of mammals include: humans; non-human primates such as monkeys; laboratory animals such as rats, mice, guinea pigs; domestic animals such as cats, dogs, rabbits, cattle, sheep, goats, horses, and pigs; and captive wild animals such as lions, tigers, elephants, and the like.

The term "membrane-bound" means that after a nucleotide sequence encoding a particular polypeptide is expressed by a host cell, the expressed polypeptide is bound to, attached to, or otherwise associated with, the membrane of the cell.

The term "neoplastic disorder" refers to a condition in which cells proliferate at an abnormally high and uncontrolled rate, the rate exceeding and uncoordinated with that of the surrounding normal tissues. It usually results in a solid lesion or lump known as "tumor." This term encompasses benign and malignant neoplastic disorders. The term "malignant neoplastic disorder", which is used interchangeably with the term "cancer" in the present disclosure, refers to a neoplastic disorder characterized by the ability of the tumor cells to spread to other locations in the body (known as "metastasis"). The term "benign neoplastic disorder" refers to a neoplastic disorder in which the tumor cells lack the ability to metastasize.

The term "mutation" refers to deletion, addition, or substitution of amino acid residues in the amino acid sequence of a protein or polypeptide as compared to the amino acid sequence of a reference protein or polypeptide.

The term "operably linked" refers to a juxtaposition wherein the components described are in a relationship permitting them to function in their intended manner. A control sequence "operably linked" to a transgene is ligated in such a way that expression of the transgene is achieved under conditions compatible with the control sequences.

The term "pharmaceutically composition" refers to a solid or liquid composition suitable for administration to a subject (e.g. a human patient) for eliciting a desired physiological, pharmacological, or therapeutic effect. In addition to containing one or more active ingredients, a pharmaceutical composition may contain one or more pharmaceutically acceptable excipients.

The term "pharmaceutically acceptable excipient" refers to a substance in an immunogenic, pharmaceutical, or vaccine composition, other than the active ingredients (e.g., the antigen, antigen-coding nucleic acid, immune modulator, or adjuvant) that is compatible with the active ingredients and does not cause significant untoward effect in subjects to whom it is administered.

The terms "peptide," "polypeptide," and "protein" are used interchangeably herein, and refer to a polymeric form of amino acids of any length, which can include coded and non-coded amino acids, chemically, or biochemically modified or derivatized amino acids, and polypeptides having modified polypeptide backbones.

The term "preventing" or "prevent" refers to (a) keeping a disorder from occurring or (b) delaying the onset of a disorder or onset of symptoms of a disorder.

The term "secreted" in the context of a polypeptide means that after a nucleotide sequence encoding the polypeptide is expressed by a host cell, the expressed polypeptide is secreted outside of the host cell.

The term "suboptimal dose" when used to describe the amount of an immune modulator, such as a protein kinase inhibitor, refers to a dose of the immune modulator that is below the minimum amount required to produce the desired therapeutic effect for the disease being treated when the immune modulator is administered alone to a patient. The term "treating," "treatment," or "treat" refers to abrogating a disorder, reducing the severity of a disorder, or reducing the severity or occurrence frequency of a symptom of a disorder.

The term "tumor-associated antigen" or "TAA" refers to an antigen which is specifically expressed by tumor cells or expressed at a higher frequency or density by tumor cells than by non-tumor cells of the same tissue type. Tumor-associated antigens may be antigens not normally expressed by the host; they may be mutated, truncated, misfolded, or otherwise abnormal manifestations of molecules normally expressed by the host; they may be identical to molecules normally expressed but expressed at abnormally high levels; or they may be expressed in a context or milieu that is abnormal. Tumor-associated antigens may be, for example, proteins or protein fragments, complex carbohydrates, gangliosides, haptens, nucleic acids, or any combination of these or other biological molecules.

The term "vaccine" refers to an immunogenic composition for administration to a mammal (such as a human) for eliciting a protective immune response against a particular antigen or antigens. The primary active ingredient of a vaccine is the immunogen(s).

The term "vector" refers to a nucleic acid molecule, or a modified microorganism, that is capable of transporting or transferring a foreign nucleic acid molecule into a host cell. The foreign nucleic acid molecule is referred to as "insert" or "transgene." A vector generally consists of an insert and a larger sequence that serves as the backbone of the vector. Based on the structure or origin of vectors, major types of vectors include plasmid vectors, cosmid vectors, phage vectors (such as lambda phage), viral vectors (such as adenovirus vectors), artificial chromosomes, and bacterial vectors.

B. Immunogenic Tumor-Associated-Antigen (TAA) Polypeptides

In some aspects, the present disclosure provides isolated immunogenic MUC1 polypeptides, TERT polypeptides, and MSLN polypeptides, which are useful, for example, for eliciting an immune response in a subject against MUC1, TERT, and MSLN, respectively, or for use as a component in vaccines for treating cancer, such as pancreatic, ovarian, and breast cancer, particularly triple-negative breast cancer.

These immunogenic TAA polypeptides can be prepared by methods known in the art in light of the present disclosure. The capability of the polypeptides to elicit an immune response can be measured in in vitro assays or in vivo assays. In vitro assays for determining the capability of a polypeptide or DNA construct to elicit immune responses are known in the art. One example of such in vitro assays is to measure the capability of the polypeptide or nucleic acid expressing a polypeptide to stimulate T cell response as described in U.S. Pat. No. 7,387,882, the disclosure of which is incorporated in this application. The assay method comprises the steps of: (1) contacting antigen presenting cells in culture with an antigen thereby the antigen can be taken up and processed by the antigen presenting cells, producing one or more processed antigens; (2) contacting the antigen presenting cells with T cells under conditions sufficient for the T cells to respond to one or more of the processed antigens; (3) determining whether the T cells respond to one or more of the processed antigens. The T cells used may be CD8$^+$ T cells or CD4$^+$ T cells. T cell response may be determined by measuring the release of one or more of cytokines, such as interferon-gamma and interleukin-2, and lysis of the antigen presenting cells (tumor cells). B cell response may be determined by measuring the production of antibodies.

B-1. Immunogenic MUC1 Polypeptides

In one aspect, the present disclosure provides isolated immunogenic MUC1 polypeptides derived from a human native MUC1, wherein the MUC1 polypeptides display one or more introduced mutations relative to the human native MUC1 protein. Examples of mutations include deletion of some, but not all, of the tandem repeats of 20 amino acids in the VNTR region of the MUC1 protein, deletion of the signal peptide sequence in whole or in part, and deletion of amino acids of non-consensus amino acid sequences found in the MUC1 isoforms. Thus, in some embodiments, the immunogenic MUC1 polypeptides provided by the present disclosure comprise (1) the amino acid sequence of 3 to 30 tandem repeats of 20 amino acids of a human MUC1 protein and (2) the amino acid sequences of the human MUC1 protein that flank the VNTR region. In some particular embodiments, the immunogenic MUC1 polypeptides comprise (1) the amino acid sequence of 5 to 25 tandem repeats of the human MUC1 and (2) the amino acid sequences of the human MUC1 protein that flank the VNTR region. In some further embodiments, the immunogenic MUC1 polypeptides are in cytoplasmic form (or "cMUC1"). The term "cytoplasmic form" refers to an immunogenic MUC1 polypeptide that lacks in whole or in part the secretory sequence (amino acids 1-23; also known as "signal peptide sequence") of the human native MUC1 protein. The deletion of amino acids of the secretory sequence is expected to prevent the polypeptide from entering the secretory pathway as it is expressed in the cells. In some other embodiments, the immunogenic MUC1 polypeptides comprise the amino acid sequence of a membrane-bond form of the MUC1.

The immunogenic MUC1 polypeptides provided by the present disclosure may be derived, constructed, or prepared from the amino acid sequence of any of the human MUC1 isoforms known in the art or discovered in the future, including, for example, Uniprot isoforms 1, 2, 3, 4, 5, 6, Y, 8, 9, F, Y-LSP, S2, M6, ZD, T10, E2, and J13 (Uniprot P15941-1 through P15941-17, respectively). In some embodiments, the immunogenic MUC1 polypeptides comprise an amino acid sequence that is part of human MUC1 isoform 1 wherein the amino acid sequence of the human MUC1 isoform 1 is set forth in SEQ ID NO:1. In a specific embodiment, the immunogenic MUC1 polypeptide comprises amino acids 24-225 and 1098-1255 of the amino acid sequence of SEQ ID NO:1. In another specific embodiment, the immunogenic MUC1 polypeptide comprises amino acids 22-225 and 946-1255 of the amino acid sequence of SEQ ID NO:1. In some other specific embodiments, the immunogenic MUC1 polypeptide comprises, or consists of, the amino acid sequence selected from the group consisting of:

(1) the amino acid sequence of SEQ ID NO:8 (Plasmid 1027 polypeptide);

(2) an amino acid sequence comprising amino acids 4-537 of SEQ ID NO:8;

(3) an amino acid sequence comprising amino acids 24-537 of SEQ ID NO:8;

(4) the amino acid sequence of SEQ ID NO:16 (Plasmid 1197 polypeptide);

(5) an amino acid sequence comprising amino acids 4-517 of SEQ ID NO:16;

and (6) an amino acid sequence comprising amino acids 4-517 of SEQ ID NO:16, wherein in SEQ ID NO:16 the amino acid at position 513 is T.

In some specific embodiments, the immunogenic MUC1 polypeptides comprise the amino acid sequence of SEQ ID NO:8 (Plasmid 1027 polypeptide) or SEQ ID NO:16 (Plasmid 1197 polypeptide).

B-2. Immunogenic MSLN Polypeptides

In one aspect, the present disclosure provides isolated immunogenic MSLN polypeptides derived from a human MSLN precursor by deletion of a portion or the entire signal peptide sequence of the MSLN precursor. Thus, the immunogenic MSLN polypeptides comprise the amino acid sequence of a native human MSLN precursor, wherein part or the entire signal peptide sequence of the MSLN precursor is absent. In some embodiments, part of, or the entire, GPI anchor sequence of the native human MSLN (i.e., amino acids 598-622 of SEQ ID NO:2) is also absent in the immunogenic MSLN polypeptide. As used herein, the term "human MSLN" encompasses any human MSLN isoform, such as isoform 1, 2, 3, or 4. In some particular embodiments, the human MSLN is human MSLN isoform 2.

In some particular embodiments, the isolated immunogenic MSLN polypeptide is selected from the group consisting of:

1) a polypeptide comprising, or consisting of, amino acids 37-597 of the amino acid sequence of SEQ ID NO:2;

2) a polypeptide comprising an amino acid sequence that is at least 90%, 95%, 98%, or 99% identical to the amino acid sequence consisting of amino acids 37-597 of the amino acid sequence of SEQ ID NO:2;

3) a polypeptide comprising, or consisting of, the amino acid sequence of SEQ ID NO:6, or amino acids 4-564 of the amino acid sequence of SEQ ID NO:6; and 4) a polypeptide comprising an amino acid sequence that has at least 93%-99%, 94%-98%, or 94%-97% identity to the amino acid sequence of SEQ ID NO:6 ("Plasmid 1103 Polypeptide").

B-3. Immunogenic TERT Polypeptides

In another aspect, the present disclosure provides isolated immunogenic TERT polypeptides derived from a human TERT protein by deletion of up to 600 of the N-terminal amino acids of the TERT protein. Thus, in some embodiments, the immunogenic TERT polypeptides comprise the amino acid sequence of TERT isoform 1 set forth in SEQ ID NO:3, wherein up to about 600 amino acids from the N-terminus (amino terminus) of the amino acid sequence of TERT isoform 1 are absent. Any number of amino acids up to 600 from the N-terminus of the TERT isoform 1 may be absent in the immunogenic TERT polypeptide. For example, the N-terminal amino acids from position 1 through position 50, 100, 50, 200, 245, 300, 350, 400, 450, 500, 550, or 600 of the TERT isoform 1 of SEQ ID NO:3 may be absent from the immunogenic TERT polypeptide. Thus, an immunogenic TERT polypeptide provided by the present disclosure may comprise amino acids 51-1132, 101-1132, 151-1132, 201-1132, 251-1132, 301-1132, 351-1132, 401-1132, 451-1132, 501-1132, or 551-1132 of SEQ ID NO:3. The immunogenic TERT polypeptides may also be constructed from other TERT isoforms. Where the polypeptides are constructed from TERT isoforms with C-terminal truncations, however, it is preferred that fewer amino acids may be deleted from the N-terminus.

In some further embodiments, the immunogenic TERT polypeptide further comprises one or more amino acid mutations that inactivate the TERT catalytic domain. Examples of such amino acid mutations include substitution of aspartic acid with alanine at position 712 of SEQ ID NO:3 (D712A) and substitution of valine with isoleucine at position 713 of SEQ ID NO:3 (V7131). In some embodiments the immunogenic TERT polypeptide comprises both mutations D712A and V7131.

In some specific embodiments, the present disclosure provides an immunogenic TERT polypeptide selected from the group consisting of:

1) a polypeptide comprising an amino acid sequence of SEQ ID NO:10 or amino acids 2-892 of SEQ ID NO:10 ("Plasmid 1112 Polypeptide"); or a functional variant of the polypeptide;

2), a polypeptide comprising an amino acid sequence of SEQ ID NO:14 or amino acids 3-789 of SEQ ID NO:14 ("Plasmid 1326 Polypeptide"), or a functional variant of the polypeptide; and 3) a polypeptide comprising an amino acid sequence of SEQ ID NO:12 or amino acids 4-591 of SEQ ID NO:12 ("Plasmid 1330 Polypeptide"), or a functional variant of the polypeptide.

C. Nucleic Acid Molecules Encoding Immunogenic TAA Polypeptides

In some aspects, the present disclosure provides nucleic acid molecules that each encode one, two, three, or more separate immunogenic TAA polypeptides that are provided by the present disclosure. The nucleic acid molecules can be deoxyribonucleotides (DNA) or ribonucleotides (RNA). Thus, a nucleic acid molecule can comprise a nucleotide sequence disclosed herein wherein thymidine (T) can also be uracil (U), which reflects the differences between the chemical structures of DNA and RNA. The nucleic acid molecules can be modified forms, single or double stranded forms, or linear or circular forms. The nucleic acid molecules can be prepared using methods known in the art light of the present disclosure.

C-1. Single-Antigen Constructs

In one aspect, the present disclosure provides an isolated nucleic acid molecule, which comprises a nucleotide sequence encoding a single immunogenic MUC1 polypeptide, a single immunogenic MSLN polypeptide, or a single immunogenic TERT polypeptide provided by the present disclosure. A nucleic acid molecule that encodes only one immunogenic TAA polypeptide, such as an immunogenic MUC1 polypeptide, an immunogenic MSLN polypeptide, or an immunogenic TERT, is also referred to herein as "single-antigen construct."

C-1a. MUC1 Single Antigen Constructs

In some embodiments, the present disclosure provides isolated nucleic acid molecules that encode an immunogenic MUC1 polypeptide provided in the present disclosure. The immunogenic MUC1 polypeptide encoded by a nucleic acid molecule may be in cytoplasmic form (or cMUC1) or "membrane-bound form (or mMUC1). The term "membrane-bound form" refers to an immunogenic MUC1 polypeptide that, after being expressed from the coding nucleic acid by a host cell, is bound to, attached to, or otherwise associated with, the membrane of the host cell.

In some specific embodiments, the isolated nucleic acid molecules provided by the present disclosure comprise a nucleotide sequence that encodes an immunogenic MUC1 polypeptide selected from the group consisting of:

(1) an immunogenic MUC1 polypeptide comprising the amino acid sequence of SEQ ID NO:8 (Plasmid 1027 polypeptide);

(2) an immunogenic MUC1 polypeptide comprising amino acids 4-537 of SEQ ID NO:8;

(3) an immunogenic MUC1 polypeptide comprising amino acids 24-537 of SEQ ID NO:8;

(4) an immunogenic MUC1 polypeptide comprising the amino acid sequence of
SEQ ID NO:16 (Plasmid 1197 polypeptide);

(5) an immunogenic MUC1 polypeptide comprising amino acids 4-517 of SEQ ID NO:16;

(6) an immunogenic MUC1 polypeptide comprising amino acids 4-517 of SEQ ID NO:16, with the proviso that the amino acid at position 513 is T; and (7) an immunogenic MUC1 polypeptide comprising amino acids 24-225 and 946-1255 of SEQ ID NO:1.

In some other specific embodiments, the isolated nucleic acid molecules provided by the present disclosure comprise a nucleotide sequence, or a degenerate variant thereof, selected from the group consisting of:

(1) the nucleotide sequence of SEQ ID NO:7 (Plasmid 1027);

(2) a nucleotide sequence comprising nucleotides 10-1611 of SEQ ID NO:7;

(3) the nucleotide sequence of SEQ ID NO:15 (Plasmid 1197); and (4) a nucleotide sequence comprising nucleotides 10-1551 of SEQ ID NO:15; C-1b. MSLN Single Antigen Constructs In some embodiments, the present disclosure provides isolated nucleic acid molecules that encode an immunogenic MSLN polypeptide provided in the present disclosure.

In some particular embodiments, the isolated nucleic acid molecule encodes an immunogenic MSLN polypeptide selected from the group consisting of:

1) an immunogenic MSLN polypeptide comprising, or consisting of, amino acids 37-597 of the amino acid sequence of SEQ ID NO:2;

2) an immunogenic MSLN polypeptide comprising an amino acid sequence that is at least 90%, 95%, 98%, or 99% identical to the amino acid sequence consisting of amino acids 37-597 of the amino acid sequence of SEQ ID NO:2;

3) an immunogenic MSLN polypeptide comprising, or consisting of, the amino acid sequence of SEQ ID NO:6; and 4) an immunogenic MSLN polypeptide comprising an amino acid sequence that has at least 93%-99%, 94%-98%, or 94%-97% identity to the amino acid sequence of SEQ ID NO:6 ("Plasmid 1103 Polypeptide").

In some other specific embodiments, the isolated nucleic acid molecules provided by the present disclosure comprise a nucleotide sequence, or a degenerate variant thereof, selected from the group consisting of:

(1) the nucleotide sequence of SEQ ID NO:5; and (2) a nucleotide sequence comprising nucleotides 10-1692 of SEQ ID NO:5.

C-1c. TERT Single Antigen Constructs

In some other embodiments, the present disclosure provides isolated nucleic acid molecules that encode an immunogenic TERT polypeptide provided in the present disclosure.

An immunogenic TERT polypeptide encoded by a nucleic acid provided by the represent disclosure may contain a deletion of maximum of 600 amino acids from the N-terminus of the amino acid sequence of TERT isoform 1. Generally, an immunogenic TERT polypeptide may be expected to possess stronger immunogenicity if it has deletion of fewer amino acids from the N-terminus of the TERT protein. The number of N-terminal amino acids that can be deleted from the TERT protein may be determined based on how the nucleic acid molecule encoding the polypeptide is intended to be used or delivered. For example, where the nucleic acid molecule is to be delivered using a particular viral vector, the deletion may be determined based on the capacity of the vector used.

In some embodiments, the immunogenic TERT polypeptides encoded by the nucleic acid molecules comprise one or more amino acid mutations that inactivate the TERT catalytic domain. Examples of such amino acid mutations include substitution of aspartic acid with alanine at position 712 of SEQ ID NO:3 (D712A) and substitution of valine with isoleucine at position 713 of SEQ ID NO:3 (V7131). In some embodiments the immunogenic TERT polypeptide comprises both mutations D712A and V7131.

In some specific embodiments, the isolated nucleic acid molecules encode an immunogenic TERT polypeptide selected from the group consisting of:

(1) an immunogenic TERT polypeptide comprising an amino acid sequence of SEQ ID NO:10 or amino acids 2-892 of SEQ ID NO:10 ("Plasmid 1112 Polypeptide"), or a functional variant of the polypeptide;

(2), an immunogenic TERT polypeptide comprising an amino acid sequence of SEQ ID NO:14 or amino acids 3-789 of SEQ ID NO:14 ("Plasmid 1326 Polypeptide" or a functional variant of the polypeptide; and (3) an immunogenic TERT polypeptide comprising an amino acid sequence of SEQ ID NO:12 or amino acids 4-591 of SEQ ID NO:12 ("Plasmid 1330 Polypeptide"), or a functional variant of the polypeptide.

In some particular embodiments, the isolated nucleic acid molecules comprise a nucleotide sequence, or a degenerate variant thereof, selected from the group consisting of:

(1) the nucleotide sequence of SEQ ID NO:9 (TERT240), (2) a nucleotide sequence comprising nucleotides 4-2679 of SEQ ID NO:9; (3) the nucleotide sequence of SEQ ID NO:11 (TERT541), (4) a nucleotide sequence comprising nucleotides 10-1782 of SEQ ID NO:11; (5) the nucleotide sequence of SEQ ID NO:13 (TERT342); and (6) a nucleotide sequence comprising nucleotides 7-2373 of SEQ ID NO:13.

C-2. Multi-Antigen Constructs

In another aspect, the present disclosure provides nucleic acid molecules that each encode two, three, or more different immunogenic TAA polypeptides. A nucleic acid molecule that encodes more than one immunogenic TAA polypeptide is also referred to as "multi-antigen construct," "multi-antigen vaccine," "multi-antigen plasmid," and the like, in the present disclosure. A nucleic acid molecule that encodes two different immunogenic TAA polypeptides is also referred to as a "dual-antigen construct," "dual antigen vaccine," or "dual antigen plasmid," etc., in this disclosure. A nucleic acid molecule that encodes three different immunogenic TAA polypeptides is also referred to as a "triple-antigen construct," "triple-antigen vaccine," or "triple-antigen plasmid" in this disclosure.

Multi-antigen constructs provided by the present disclosure can be prepared using various techniques known in the art in light of the disclosure. For example, a multi-antigen construct can be constructed by incorporating multiple independent promoters into a single plasmid (Huang, Y., Z. Chen, et al. (2008). "Design, construction, and characterization of a dual-promoter multigenic DNA vaccine directed against an HIV-1 subtype C/B' recombinant." J Acquir Immune Defic Syndr 47(4): 403-411; Xu, K., Z. Y. Ling, et al. (2011). "Broad humoral and cellular immunity elicited by a bivalent DNA vaccine encoding HA and NP genes from an H5N1 virus." Viral Immunol 24(1): 45-56). The plasmid can be engineered to carry multiple expression cassettes, each consisting of a) a eukaryotic promoter for initiating RNA polymerase dependent transcription, with or without an enhancer element, b) a gene encoding a target antigen, and c) a transcription terminator sequence. Upon delivery of the plasmid to the transfected cell nucleus, transcription will be initiated from each promoter, resulting in the production of separate mRNAs, each encoding one of the target antigens. The mRNAs will be independently translated, thereby producing the desired antigens.

Multi-antigen constructs provided by the present disclosure can also be constructed through the use of viral 2A peptides (Szymczak, A. L. and D. A. Vignali (2005). "Development of 2A peptide-based strategies in the design of multicistronic vectors." Expert Opin Biol Ther 5(5): 627-638; de Felipe, P., G. A. Luke, et al. (2006). "E unum pluribus: multiple proteins from a self-processing polyprotein." Trends Biotechnol 24(2): 68-75; Luke, G. A., P. de Felipe, et al. (2008). "Occurrence, function and evolutionary origins of '2A-like' sequences in virus genomes." J Gen Virol 89 (Pt 4): 1036-1042; Ibrahimi, A., G. Vande Velde, et al. (2009). "Highly efficient multicistronic lentiviral vectors with peptide 2A sequences." Hum Gene Ther 20(8): 845-860; Kim, J. H., S. R. Lee, et al. (2011). "High cleavage efficiency of a 2A peptide derived from porcine teschovirus-1 in human cell lines, zebrafish and mice." PLoS One 6(4): e18556). These peptides, also called cleavage cassettes or CHYSELs (cis-acting hydrolase elements), are approximately 20 amino acids long with a highly conserved carboxy terminal D-V/I-EXNPGP motif (Table 19). These peptides are rare in nature, most commonly found in viruses such as Foot-and-mouth disease virus (FMDV), Equine rhinitis A virus (ERAV), Equine rhinitis B virus (ERBV), Encephalomyocarditis virus (EMCV), Porcine teschovirus (PTV), and Thosea asigna virus (TAV) (Luke, G. A., P. de Felipe, et al. (2008). "Occurrence, function and evolutionary origins of '2A-like' sequences in virus genomes." J Gen Virol 89 (Pt 4): 1036-1042). With a 2A-based multi-antigen expression strategy, genes encoding multiple target antigens are linked together in a single open reading frame, separated by sequences encoding viral 2A peptides. The entire open reading frame can be cloned into a vector with a single promoter and terminator. Upon delivery of the constructs to a host cell, mRNA encoding the multiple antigens will be transcribed and translated as a single polyprotein. During translation of the 2A peptides, ribosomes skip the bond between the C-terminal glycine and proline. The ribosomal skipping acts like a cotranslational autocatalytic "cleavage" that releases the peptide sequences upstream of the 2A peptide from those downstream. The incorporation of a 2A peptide between two protein antigens may result in the addition of ~20 amino acids onto the C-terminus of the upstream polypeptide and 1 amino acid (proline) to the N-terminus of downstream protein. In an adaptation of this methodology, protease cleavage sites can be incorporated at the N terminus of the 2A cassette such that ubiquitous proteases will cleave the cassette from the upstream protein (Fang, J., S. Yi, et al. (2007). "An antibody delivery system for regulated expression of therapeutic levels of monoclonal antibodies in vivo." Mol Ther 15(6): 1153-1159).

Another strategy for constructing the multi-antigen constructs provided by the present disclosure involves the use of an internal ribosomal entry site, or IRES. Internal ribosomal entry sites are RNA elements found in the 5' untranslated regions of certain RNA molecules (Bonnal, S., C. Boutonnet, et al. (2003). "IRESdb: the Internal Ribosome Entry Site database." Nucleic Acids Res 31(1): 427-428). They attract eukaryotic ribosomes to the RNA to facilitate translation of downstream open reading frames. Unlike normal cellular 7-methylguanosine cap-dependent translation, IRES-mediated translation can initiate at AUG codons far within an RNA molecule. The highly efficient process can be exploited for use in multi-cistronic expression vectors (Bochkov, Y. A. and A. C. Palmenberg (2006). "Translational efficiency of EMCV IRES in bicistronic vectors is dependent upon IRES sequence and gene location." Biotechniques 41(3): 283-284, 286, 288). Typically, two transgenes are inserted into a vector between a promoter and transcription terminator as two separate open reading frames separated by an IRES. Upon delivery of the constructs to a host cell, a single long transcript encoding both transgenes will be transcribed. The first open reading frame (ORF) will be translated in the traditional cap-dependent manner, terminating at a stop codon upstream of the IRES. The second ORF will be translated in a cap-independent manner using the IRES. In this way, two independent proteins can be produced from a single mRNA transcribed from a vector with a single expression cassette.

In some aspects, the present disclosure provides a dual-antigen construct comprising two coding nucleotide sequences, wherein each of the coding nucleotide sequences encodes an individual immunogenic TAA polypeptide. The structure of such a dual-antigen construct is shown in formula (I):

TAA1-SPACER1-TAA2 (I), wherein in formula (I):

(i) TAA1 and TAA2 are nucleotide sequences each encoding an immunogenic TAA polypeptides selected from the group consisting of an immunogenic MUC1 polypeptide, an immunogenic MSLN polypeptide, and an immunogenic TERT polypeptide, wherein TAA1 and TAA 2 encode different immunogenic TAA polypeptides; and (ii) SPACER1 is a spacer nucleotide sequence, or may be absent.

In some embodiments, the present disclosure provides a dual-antigen construct of formula (I), wherein in formula (I) TAA1 is a nucleotide sequence encoding an immunogenic MUC1 polypeptide, and TAA2 is a nucleotide sequence encoding an immunogenic MSLN polypeptide or immunogenic TERT polypeptide.

In some other embodiments, the present disclosure provides a dual-antigen construct of formula (I), wherein in formula (I) TAA1 is a nucleotide sequence encoding an immunogenic MSLN polypeptide, and TAA2 is a nucleotide sequence encoding an immunogenic MUC1 polypeptide or immunogenic TERT polypeptide.

In some further embodiments, the present disclosure provides a dual-antigen construct of formula (I), wherein in formula (I) TAA1 is a nucleotide sequence encoding an immunogenic TERT polypeptide, and TAA2 is a nucleotide sequence encoding an immunogenic MUC1 polypeptide or immunogenic MSLN polypeptide.

In some specific embodiments, the present disclosure provides a dual-antigen construct of a formula selected from a group consisting of:

| (1) MUC1-2A-TERT | (II) |
| (2) MUC1-2A-MSLN | (III) |
| (3) MSLN-2A-TERT | (IV) |
| (4) MSLN-2A-MUC1 | (V) |
| (5) TERT-2A-MSLN | (VI) |
| (6) TERT-2A-MUC1 | (VII) | wherein in each of formulas (II)-(VII): (i) MUC1, MSLN, and TERT represent a nucleotide sequence encoding an immunogenic MUC1 polypeptide, an immunogenic MSLN polypeptide, and an immunogenic TERT polypeptide, respectively, and (ii) 2A is a nucleotide sequence encoding a 2A peptide.

In some other aspects, the present disclosure provides a triple-antigen construct comprising three coding nucleotide sequences wherein each of the coding nucleotide sequences expresses a different individual immunogenic TAA polypeptide. The structure of a triple-antigen construct is shown in formula (VIII):

TAA1-SPACER1-TAA2-SPACER2-TAA3 (VIII)

wherein in formula (VIII):

(i) TAA1, TAA2, and TAA3 are each a nucleotide sequence encoding an immunogenic TAA polypeptide selected from the group consisting of an immunogenic MUC1 polypeptide, an immunogenic MSLN polypeptide, and an immunogenic TERT polypeptide, wherein TAA1, TAA2, and TAA3 encode different immunogenic TAA polypeptides; and (ii) SPACER1 and SPACER2 are each a spacer nucleotide sequence, wherein (a) SPACER1 and SPACER2 may be the same or different and (b) either SPACER1 or SPACER2 or both SPACER1 and SPACER2 may be absent.

The term "spacer nucleotide sequence" as used in the present disclosure refers to a nucleotide sequence that is inserted between two coding sequences or transgenes in an open reading frame of a nucleic acid molecule and functions to allow co-expression or translation of two separate gene products from the nucleic acid molecule. Examples of spacer nucleotide sequences that may be used in the multi-antigen constructs provided by the present disclosure include eukaryotic promoters, nucleotide sequences encoding a 2A peptide, and internal ribosomal entry sites (IRES). Examples of 2A peptides include foot-and-mouth disease virus 2A peptide (FMD2A), equine rhinitis A virus 2A peptide (ERA2A), Equine rhinitis B virus 2A peptide (ERB2A), encephalomyocarditis virus 2A peptide (EMC2A), porcine teschovirus 2A peptide (PT2A), and Thosea asigna virus 2A peptide (T2A). The sequences of these 2A peptides are provided in Table 19.

In some embodiments, SPACER1 and SPACER2 are, independently, a nucleotide sequence encoding a 2A peptide, or a nucleotide sequence encoding GGSGG.

In some embodiments, the present disclosure provides a triple-antigen construct of formula (VIII), wherein in formula (VIII) (i) TAA1 is a nucleotide sequence encoding an immunogenic MUC1 polypeptide, (ii) TAA2 is a nucleotide sequence encoding an immunogenic MSLN polypeptide, and (iii) TAA3 is a nucleotide sequence encoding an immunogenic TERT polypeptide.

In some other embodiments, the present disclosure provides a triple-antigen construct of formula (VIII), wherein in formula (VIII) (i) TAA1 is a nucleotide sequence encoding an immunogenic MUC1 polypeptide, (ii) TAA2 is a nucleotide sequence encoding an immunogenic TERT polypeptide, and (iii) TAA3 is a nucleotide sequence encoding an immunogenic MSLN polypeptide.

In some other embodiments, the present disclosure provides a triple-antigen construct of formula (VIII), wherein in formula (VIII) (i) TAA1 is a nucleotide sequence encoding an immunogenic MSLN polypeptide, (ii) TAA2 is a nucleotide sequence encoding an immunogenic TERT polypeptide, and (iii) TAA3 is a nucleotide sequence encoding an immunogenic MUC1 polypeptide.

In some other embodiments, the present disclosure provides a triple-antigen construct of formula (VIII), wherein in formula (VIII) (i) TAA1 is a nucleotide sequence encoding an immunogenic MSLN polypeptide, (ii) TAA2 is a nucleotide sequence encoding an immunogenic MUC1 polypeptide, and (iii) TAA3 is a nucleotide sequence encoding an immunogenic TERT polypeptide.

In some specific embodiments, the present disclosure provides a triple-antigen construct of a formula selected from the group consisting of:

| | |
|---|---|
| (1) MUC1-2A-MSLN-2A-TERT | (IX) |
| (2) MUC1-2A-TERT-2A-MSLN | (X) |
| (3) MSLN-2A-MUC1-2A-TERT | (XI) |
| (4) MSLN-2A-TERT-2A-MUC1 | (XII) |
| (5) TERT-2A-MUC1-2A-MSLN | (XIII) |
| (6) TERT-2A-MSLN-2A-MUC1 | (XIV) | wherein in each of formulas (IX)-(XIV: (i) MUC1, MSLN, and TERT represent a nucleotide sequence encoding an immunogenic MUC1 polypeptide, an immunogenic MSLN polypeptide, and an immunogenic TERT polypeptide, respectively, and (ii) 2A is a nucleotide sequence encoding a 2A peptide.

The immunogenic MSLN polypeptide encoded by a multi-antigen construct may be a full length MSLN protein or a fragment thereof, such as a cytoplasmic, secreted, or membrane-bound fragment. In some embodiments the multi-antigen construct comprises a nucleotide sequence encoding an immunogenic MSLN polypeptide selected from the group consisting of:

1) a polypeptide comprising, or consisting of, amino acids 37-597 of the amino acid sequence of SEQ ID NO:2;

2) a polypeptide comprising an amino acid sequence that is at least 90%, 95%, 98%, or 99% identical to the amino acid sequence consisting of amino acids 37-597 of the amino acid sequence of SEQ ID NO:2;

3) a polypeptide comprising, or consisting of, the amino acid sequence of SEQ ID NO:6, or amino acids 4-564 of the amino acid sequence of SEQ ID NO:6; and 4) polypeptide comprising an amino acid sequence that has at least 93%-99%, 94%-98%, or 94%-97% identity to the amino acid sequence of SEQ ID NO:8 ("Plasmid 1103 Polypeptide").

In some particular embodiments the multi-antigen construct comprises a nucleotide sequence of SEQ ID NO:5 or a degenerate variant thereof.

The immunogenic MUC1 polypeptide encoded by a multi-antigen construct may comprise (1) an amino acid sequence of 3 to 30 tandem repeats of 20 amino acids of a human MUC1 protein and (2) the amino acid sequences of the human MUC1 protein that flank the VNTR region. In some embodiments the multi-antigen construct comprises a nucleotide sequence encoding an immunogenic MUC1 polypeptide, wherein the immunogenic MUC1 polypeptide comprises, or consists of, the amino acid sequence selected from the group consisting of:

(1) the amino acid sequence of SEQ ID NO:8 (Plasmid 1027 polypeptide);

(2) an amino acid sequence comprising amino acids 4-537 of SEQ ID NO:8;

(3) an amino acid sequence comprising amino acids 24-537 of SEQ ID NO:8;

(4) the amino acid sequence of SEQ ID NO:16 (Plasmid 1197 polypeptide);

(5) an amino acid sequence comprising amino acids 4-517 of SEQ ID NO:16; and (6) an amino acid sequence comprising amino acids 4-517 of SEQ ID NO:16, with the proviso that the amino acid at position 513 is T.

In some particular embodiments, the multi-antigen construct comprises a nucleotide sequence of SEQ ID NO:7, a nucleotide sequence of SEQ ID NO:15, or a degenerate variant of the nucleotide sequence of SEQ ID NO:7 or 15.

The immunogenic TERT polypeptide encoded by a multi-antigen construct may be the full length protein or any truncated form. The full length TERT protein is expected to generate stronger immune responses than a truncated form. However, depending on the specific vector chosen to deliver the construct, the vector may not have the capacity to carry the gene encoding the full TERT protein. Therefore, deletions of some amino acids from the protein may be made such that the transgenes would fit into a particular vector. The deletions of amino acids can be made from the N-terminus, C-terminus, or anywhere in the sequence of the TERT protein. Additional deletions may be made in order to remove the nuclear localization signal, thereby rendering the polypeptides cytoplasmic, increasing access to cellular antigen processing/presentation machinery. In some embodiments, the amino acids up to position 200, 300, 400, 500, or 600 of the N-terminus of the TERT protein are absent from the immunogenic TERT polypeptides.

Mutations of additional amino acids may be introduced in order to inactivate the TERT catalytic domain. Examples of such mutations include D712A and V713T.

In some further embodiments, the multi-antigen construct comprises a nucleotide sequence encoding an immunogenic TERT polypeptide, wherein the immunogenic TERT polypeptide comprises, or consist of, an amino acid sequence selected from the group consisting of;

1) the amino acid sequence of SEQ ID NO:10 ("Plasmid 1112 Polypeptide"; TERT 240);
2) the amino acid sequence of SEQ ID NO:12 ("Plasmid 1330 Polypeptide"; TERT 541); and
3) the amino acid sequence of SEQ ID NO: 14 ("Plasmid 1326 Polypeptide"; TERT 343).

In some particular embodiments, the multi-antigen construct comprises the nucleotide sequence of SEQ ID NO:9, 11, or 13, or a degenerate variant of the nucleotide sequence of SEQ ID NO:9, 11, or 13.

In some particular embodiments, the present disclosure provides a dual antigen construct encoding an immunogenic MUC1 polypeptide and an immunogenic MSLN polypeptide, which comprises a nucleotide sequence selected from the group consisting of:
(1) a nucleotide sequence encoding the amino acid sequence of SEQ ID NO:18, 20, 22, or 24;
(2) the nucleotide sequence of SEQ ID NO:17, 19, 21, or 23; and
(3) a degenerate variant of the nucleotide sequence of SEQ ID NO:17, 19, 21, or 23.

In some other particular embodiments, the present disclosure provides a dual antigen construct encoding an immunogenic MUC1 polypeptide and an immunogenic TERT polypeptide, which comprises a nucleotide sequence selected from the group consisting of:
(1) a nucleotide sequence encoding the amino acid sequence of SEQ ID NO:26, 28, 30, 32, or 34;
(2) a nucleotide sequence of SEQ ID NO:25, 27, 29, 31, or 33; and
(3) a degenerate variant of the nucleotide sequence of SEQ ID NO:25, 27, 29, 31, or 33.

In some other particular embodiments, the present disclosure provides a dual antigen construct encoding an immunogenic MSLN polypeptide and an immunogenic TERT polypeptide, which comprises a nucleotide sequence selected from the group consisting of:
(1) a nucleotide sequence encoding the amino acid sequence of SEQ ID NO:36, 38, 40, or 42;
(2) the nucleotide sequence of SEQ ID NO:35, 37, 39, or 41; and
(3) a degenerate variant of the nucleotide sequence of SEQ ID NO:35, 37, 39, or 41.

In some other particular embodiments, the present disclosure provides a triple-antigen construct encoding an immunogenic MUC1 polypeptide, an immunogenic MSLN polypeptide, and an immunogenic TERT polypeptide, which comprises a nucleotide sequence selected from the group consisting of:
(1) a nucleotide sequence encoding the amino acid sequence of SEQ ID NO:44, 46, 48, 50, 52, 54, 56, 58, 60, 62, 64, or 66;
(2) the nucleotide sequence of SEQ ID NO:43, 45, 47, 49, 51, 53, 55, 57, 59, 61, 63, or 65; and
(3) a degenerate variant of the nucleotide sequence of SEQ ID NO: 43, 45, 47, 49, 51, 53, 55, 57, 59, 61, 63, or 65.

D. Vectors Containing a Nucleic Acid Molecule Encoding an Immunogenic TAA Polypeptide Another aspect of the invention relates to vectors containing one or more of any of the nucleic acid molecules provided by the present disclosure, including single antigen constructs, dual-antigen constructs, triple-antigen constructs, and other multi-antigen constructs. The vectors are useful for cloning or expressing the immunogenic TAA polypeptides encoded by the nucleic acid molecules, or for delivering the nucleic acid molecule in a composition, such as a vaccine, to a host cell or to a host subject, such as a human. In some particular embodiments, the vector comprises a triple-antigen construct encoding an immunogenic MUC1 polypeptide, an immunogenic MSLN polypeptide, and an immunogenic TERT polypeptide, wherein the triple-antigen construct which comprises a nucleotide sequence selected from the group consisting of:
(1) a nucleotide sequence encoding the amino acid sequence of SEQ ID NO:44, 46, 48, 50, 52, 54, 56, 58, 60, 62, 64, or 66;
(2) the nucleotide sequence of SEQ ID NO:43, 45, 47, 49, 51, 53, 55, 57, 59, 61, 63, or 65; and
(3) a degenerate variant of the nucleotide sequence of SEQ ID NO: 43, 45, 47, 49, 51, 53, 55, 57, 59, 61, 63, or 65.

A wide variety of vectors may be prepared to contain and express a nucleic acid molecule of the invention, such as plasmid vectors, cosmid vectors, phage vectors, and viral vectors.

In some embodiments, the disclosure provides a plasmid-based vector containing a nucleic acid molecule of the invention. Examples of suitable plasmid vectors include pBR325, pUC18, pSKF, pET23D, and pGB-2. Other examples of plasmid vectors, as well as method of constructing such vectors, are described in U.S. Pat. Nos. 5,580,859, 5,589,466, 5,688,688, 5,814,482, and 5,580,859.

In other embodiments, the present invention provides vectors that are constructed from viruses, such as retroviruses, alphaviruses, and adenoviruses. Examples of retroviral vectors are described in U.S. Pat. Nos. 5,219,740, 5,716,613, 5,851,529, 5,591,624, 5,716,826, 5,716,832, and 5,817,491. Representative examples of vectors that can be generated from alphaviruses are described in U.S. Pat. Nos. 5,091,309 and 5,217,879, 5,843,723, and 5,789,245.

In some particular embodiments, the present disclosure provides adenoviral vectors that comprise a nucleic acid sequence of non-human primate adenoviruses, such as simian adenoviruses. Examples of such adenoviral vectors, as well as their preparation, are described in PCT application publications WO2005/071093 and WO 2010/086189, and include non-replicating vectors constructed from simian adenoviruses, such as ChAd3, ChAd4, ChAd5, ChAd7, ChAd8, ChAd9, ChAd10, ChAd11, ChAd16, ChAd17, ChAd19, ChAd20, ChAd22, ChAd24, ChAd26, ChAd30, ChAd31, ChAd37, ChAd38, ChAd44, ChAd63, ChAd68, ChAd82, ChAd55, ChAd73, ChAd83, ChAd146, ChAd147, PanAd1, Pan Ad2, and Pan Ad3, and replication-competent vectors constructed simian adenoviruses Ad4 or Ad7. It is preferred that in constructing the adenoviral vectors from the simian adenoviruses one or more of the early genes from the genomic region of the virus selected from E1A, E1B, E2A, E2B, E3, and E4 are either deleted or rendered non-functional by deletion or mutation. In a particular embodiment, the vector is constructed from ChAd3 or ChAd68. Suitable vectors can also be generated from other viruses such as: (1) pox viruses, such as canary pox virus or vaccinia virus (Fisher-Hoch et al., PNAS 86:317-321, 1989; Flexner et al., Ann. N.Y. Acad. Sci. 569:86-103, 1989; Flexner et al., Vaccine 8:17-21, 1990; U.S. Pat. Nos. 4,603,112, 4,769,330 and 5,017,487; WO 89/01973); (2) SV40 (Mulligan et al., Nature 277:108-114, 1979); (3) herpes (Kit, Adv. Exp. Med.

Biol. 215:219-236, 1989; U.S. Pat. No. 5,288,641); and (4) lentivirus such as HIV (Poznansky, J. Virol. 65:532-536, 1991).

Methods of constructing vectors are well known in the art. Expression vectors typically include one or more control elements that are operatively linked to the nucleic acid sequence to be expressed. The term "control elements" refers collectively to promoter regions, polyadenylation signals, transcription termination sequences, upstream regulatory domains, origins of replication, internal ribosome entry sites ("IRES"), enhancers, and the like, which collectively provide for the replication, transcription, and translation of a coding sequence in a recipient cell. Not all of these control elements need always be present so long as the selected coding sequence is capable of being replicated, transcribed, and translated in an appropriate host cell. The control elements are selected based on a number of factors known to those skilled in that art, such as the specific host cells and source or structures of other vector components. For enhancing the expression of an immunogenic TAA polypeptide, a Kozak sequence may be provided upstream of the sequence encoding the immunogenic TAA polypeptide. For vertebrates, a known Kozak sequence is (GCC) NCCATGG, wherein N is A or G and GCC is less conserved. Exemplary Kozak sequences that may be used include GAACATGG, ACCAUGG and ACCATGG.

E. Compositions Comprising an Immunogenic TAA Polypeptide (Polypeptide Compositions)

In another aspect, the present disclosure provides polypeptide compositions, which comprise one or more isolated immunogenic TAA polypeptides provided by the present disclosure ("polypeptide composition"). In some embodiments, the polypeptide composition is an immunogenic composition useful for eliciting an immune response against a TAA protein in a subject, such as a mouse, dog, nonhuman primates or human. In some other embodiments the polypeptide composition is a pharmaceutical composition for administration to a subject, such as a human. In still other embodiments, the polypeptide composition is a vaccine composition useful for immunization of a mammal, such as a human, for inhibiting abnormal cell proliferation, for providing protection against the development of cancer (used as a prophylactic), or for treatment of disorders (used as a therapeutic) associated with TAA over expression, such as cancers.

A polypeptide composition provided by the present disclosure may contain a single type of immunogenic TAA polypeptide, such an immunogenic MSLN polypeptide, an immunogenic MUC1 polypeptide, or an immunogenic TERT polypeptide. A composition may also contain a combination of two or more different types of immunogenic TAA polypeptides. For example, a polypeptide composition may contain immunogenic TAA polypeptides in any of the following combinations:

1) an immunogenic MSLN polypeptide and an immunogenic MUC1 polypeptide;
2) an immunogenic MSLN polypeptide and a TERT polypeptide; or
3) an immunogenic MSLN polypeptide, an immunogenic MUC1 polypeptide, and a TERT polypeptide.

In some embodiments, a polypeptide composition provided by the present disclosure, such as an immunogenic composition, a pharmaceutical composition, or a vaccine composition, further comprises a pharmaceutically acceptable excipient. Pharmaceutically acceptable excipients suitable for immunogenic, pharmaceutical, or vaccine compositions are known in the art. Examples of suitable excipients that may be used in the compositions include biocompatible oils, such as rape seed oil, sunflower oil, peanut oil, cotton seed oil, jojoba oil, squalan, squalene, physiological saline solution, preservatives and osmotic pressure controlling agents, carrier gases, pH-controlling agents, organic solvents, hydrophobic agents, enzyme inhibitors, water absorbing polymers, surfactants, absorption promoters, pH modifiers, and anti-oxidative agents.

The immunogenic TAA polypeptide in a composition, particularly an immunogenic composition or a vaccine composition, may be linked to, conjugated to, or otherwise incorporated into a carrier for administration to a subject. The term "carrier" refers to a substance or structure that an immunogenic polypeptide can be attached to or otherwise associated with for delivery of the immunogenic polypeptide to the subject. The carrier itself may be immunogenic. Examples of carriers include immunogenic polypeptides, immune CpG islands, limpet hemocyanin (KLH), tetanus toxoid (TT), cholera toxin subunit B (CTB), bacteria or bacterial ghosts, liposome, chitosome, virosomes, microspheres, dendritic cells, or their like. One or more immunogenic TAA polypeptide molecules may be linked to a single carrier molecule. Methods for linking an immunogenic polypeptide to a carrier are known in the art, A vaccine composition or immunogenic composition provided by the present disclosure may be used in conjunction or combination with one or more immune modulators or adjuvants. The immune modulators or adjuvants may be formulated separately from the vaccine composition or immunogenic composition, or they may be part of the same composition formulation. Thus, in some embodiments, the present disclosure provides a vaccine composition that further comprises one or more immune modulators or adjuvants. Examples of immune modulators and adjuvants are provided herein below.

The polypeptide compositions, including the immunogenic and vaccine compositions, can be prepared in any suitable dosage forms, such as liquid forms (e.g., solutions, suspensions, or emulsions) and solid forms (e.g., capsules, tablets, or powder), and by methods known to one skilled in the art.

F. Compositions Comprising an Immunogenic TAA Nucleic Acid Molecule (Nucleic Acid Compositions)

The present disclosure also provides nucleic acid compositions, which comprise an isolated nucleic acid molecule or vector provided by the present disclosure ("nucleic acid composition"). The nucleic acid compositions are useful for eliciting an immune response against a TAA protein in vitro or in vivo in a subject, including a human. In some embodiments, the nucleic acid compositions are immunogenic compositions or pharmaceutical compositions.

In some particular embodiments, the nucleic acid composition is a DNA vaccine composition for administration to a subject, such as a human for (1) inhibiting abnormal cell proliferation, providing protection against the development of cancer (used as a prophylactic), (2) treatment of cancer (used as a therapeutic) associated with TAA over-expression, or (3) eliciting an immune response against a particular human TAA, such as MSLN, MUC1, or TERT. The nucleic acid molecule in the composition may be a "naked" nucleic acid molecule, i.e., simply in the form of an isolated DNA free from elements that promote transfection or expression.

Alternatively, the nucleic acid molecule in the composition is incorporated into a vector, such as a plasmid vector or a viral vector.

A nucleic acid composition provided by the present disclosure may comprise individual isolated nucleic acid molecules that each encode only one type of immunogenic TAA polypeptide, such as an immunogenic MSLN polypeptide, an immunogenic MUC1 polypeptide, or an immunogenic TERT polypeptide.

A nucleic acid composition may comprise a multi-antigen construct that encodes two or more types of immunogenic TAA polypeptides. For example, a multi-antigen construct may encode two or more immunogenic TAA polypeptides in any of the following combinations:

(1) an immunogenic MSLN polypeptide and an immunogenic MUC1 polypeptide;

(2) an immunogenic MSLN polypeptide and an immunogenic TERT polypeptide;

(3) an immunogenic MUC1 polypeptide and an immunogenic TERT polypeptide; and (4) an immunogenic MSLN polypeptide, an immunogenic MUC1 polypeptide, and an immunogenic TERT polypeptide.

In some particular embodiments, the compositions provided by the present disclosure comprise a dual antigen construct comprising a nucleotide sequence selected from the group consisting of:

(1) a nucleotide sequence encoding the amino acid sequence of SEQ ID NO:18, 20, 22, or 24, 26, 28, 30, 32, or 34, 36, 38, 30, 40, or 42;

(2) the nucleotide sequence of SEQ ID NO:17, 19, 21, or 23, 25, 27, 29, 31, or 33, 35, 37, 39, or 41; and (3) a degenerate variant of the nucleotide sequence of SEQ ID NO:17, 19, 21, or 23, 25, 27, 29, 31, or 33, 35, 37, 39, or 41.

In some other particular embodiments, the compositions provided by the present disclosure comprise a triple-antigen construct comprising a nucleotide sequence selected from the group consisting of:

(1) a nucleotide sequence encoding the amino acid sequence of SEQ ID NO:44, 46, 48, 50, 52, 54, 56, 58, 60, 62, 64, or 66;

(2) the nucleotide sequence of SEQ ID NO:43, 45, 47, 49, 51, 53, 55, 57, 59, 61, 63, or 65; and (3) a degenerate variant of the nucleotide sequence of SEQ ID NO: 43, 45, 47, 49, 51, 53, 55, 57, 59, 61, 63, or 65.

The nucleic acid compositions, such as a pharmaceutical composition or a DNA vaccine composition, may further comprise a pharmaceutically acceptable excipient. Pharmaceutical acceptable excipients suitable for nucleic acid compositions, including DNA vaccine compositions, are well known to those skilled in the art. Such excipients may be aqueous or nonaqueous solutions, suspensions, and emulsions. Examples of non-aqueous excipients include propylene glycol, polyethylene glycol, vegetable oils such as olive oil, and injectable organic esters such as ethyl oleate. Examples of aqueous excipient include water, alcoholic/aqueous solutions, emulsions or suspensions, including saline and buffered media. Suitable excipients also include agents that assist in cellular uptake of the polynucleotide molecule. Examples of such agents are (i) chemicals that modify cellular permeability, such as bupivacaine, (ii) liposomes or viral particles for encapsulation of the polynucleotide, or (iii) cationic lipids or silica, gold, or tungsten microparticles which associate themselves with the polynucleotides. Anionic and neutral liposomes are well-known in the art (see, e.g., Liposomes: A Practical Approach, RPC New Ed, IRL press (1990), for a detailed description of methods for making liposomes) and are useful for delivering a large range of products, including polynucleotides. Cationic lipids are also known in the art and are commonly used for gene delivery. Such lipids include Lipofectin™ also known as DOTMA (N-D-(2,3-dioleyloxy) propyls N,N,N-trimethylammonium chloride), DOTAP (1,2-bis (oleyloxy)-3 (trimethylammonio) propane), DDAB (dimethyl-dioctadecyl-ammonium bromide), DOGS (dioctadecylami-dologlycyl spermine) and cholesterol derivatives such as DCChol (3 beta-(N—(N',N'-dimethyl aminomethane)-carbamoyl) cholesterol). A description of these cationic lipids can be found in EP 187,702, WO 90/11092, U.S. Pat. No. 5,283,185, WO 91/15501, WO 95/26356, and U.S. Pat. No. 5,527,928. A particular useful cationic lipid formulation that may be used with the nucleic acid compositions provided by the disclosure is VAXFECTIN, which is a commixture of a cationic lipid (GAP-DMORIE) and a neutral phospholipid (DPyPE) which, when combined in an aqueous vehicle, self-assemble to form liposomes. Cationic lipids for gene delivery are preferably used in association with a neutral lipid such as DOPE (dioleyl phosphatidylethanolamine), as described in WO 90/11092 as an example. In addition, a nucleic acid construct, such as a DNA construct, can also be formulated with a nonionic block copolymer such as CRL1005.

A nucleic acid composition provided by the present disclosure, such as a pharmaceutical composition or immunogenic composition, may be used in conjunction or combination with one or more immune modulators. The nucleic acid composition, such as a pharmaceutical composition or immunogenic composition, may also be used in conjunction or combination with one or more adjuvants. Further, the nucleic acid composition may be used in conjunction or combination with one or more immune modulators and one or more adjuvants. The immune modulators or adjuvants may be formulated separately from the nucleic composition, or they may be part of the same composition formulation. Thus, in some embodiments, the present disclosure provides a nucleic acid vaccine composition that further comprises one or more immune modulators and/or one or more adjuvants. Examples of immune modulators and adjuvants are provided herein below.

The nucleic acid compositions, including vaccine compositions, can be prepared in any suitable dosage forms, such as liquid forms (e.g., solutions, suspensions, or emulsions) and solid forms (e.g., capsules, tablets, or powder), and by methods known to one skilled in the art.

G. Uses of the Immunogenic TAA Polypeptides, Nucleic Acid Molecules, and Compositions In other aspects, the present disclosure provides methods of using the immunogenic TAA polypeptides, isolated nucleic acid molecules, and compositions described herein above. In one aspect, the present disclosure provides a method of eliciting an immune response against a TAA in a subject, particularly a human, comprising administering to the subject an effective amount of (1) an immunogenic TAA polypeptide that is immunogenic against the target TAA, (2) an isolated nucleic acid molecule encoding one or more immunogenic TAA polypeptides, (3) a composition comprising one or more immunogenic TAA polypeptides, or (4) a composition comprising an isolated nucleic acid molecule encoding one or more immunogenic TAA polypeptides. In some embodiments, the disclosure provides a method of eliciting an immune response against MSLN in a subject, comprising administering to the subject an effective amount of an immunogenic MSLN composition provided by the present disclosure, wherein the immunogenic MSLN composition is selected from: (1) an immunogenic MSLN polypeptide, (2) an isolated nucleic acid molecule encoding an immunogenic MSLN polypeptide, (3) a composition comprising an immunogenic MSLN polypeptide, or (4) a composition comprising an isolated nucleic acid molecule encoding an immunogenic MSLN polypeptide. In some other embodiments, the disclosure provides a method of eliciting an immune response against MUC1 in a subject, comprising administering to the subject an effective amount of an immunogenic MUC1 composition provided by the present disclosure, wherein the immunogenic MUC1 composition is selected from: (1) an immunogenic MUC1 polypeptide, (2) an isolated nucleic acid molecule encoding an immunogenic MUC1 polypeptide, (3) a composition comprising an immunogenic MUC1 polypeptide, or (4) a composition comprising an isolated nucleic acid molecule encoding an immunogenic MUC1 polypeptide. In some embodiments, the disclosure provides a method of eliciting an immune response against TERT in a subject, comprising administering to the subject an effective amount of an immunogenic TERT composition provided by the present disclosure, wherein the immunogenic TERT composition is selected from: (1) an immunogenic TERT polypeptide, (2) an isolated nucleic acid molecule encoding an immunogenic TERT polypeptide, (3) a composition comprising an immunogenic TERT polypeptide, or (4) a composition comprising an isolated nucleic acid molecule encoding an immunogenic TERT polypeptide.

In another aspect, the present disclosure provides a method of inhibiting abnormal cell proliferation in a human, wherein the abnormal cell proliferation is associated with over-expression of a TAA. The method comprises administering to the human an effective amount of immunogenic TAA composition provided by the present disclosure that is immunogenic against the over-expressed TAA. The immunogenic TAA composition may be (1) an immunogenic TAA polypeptide, (2) an isolated nucleic acid molecule encoding one or more immunogenic TAA polypeptides, (3) a composition comprising an immunogenic TAA polypeptide, or (4) a composition comprising an isolated nucleic acid molecule encoding one or more immunogenic TAA polypeptides.

The abnormal cell proliferation may be in any organ or tissues of a human, such as breast, stomach, ovaries, lungs, bladder, large intestine (e.g., colon and rectum), kidneys, pancreas, and prostate. In some embodiments, the method is for inhibiting abnormal cell proliferation in the breast, ovaries, pancreas, colon, lung, stomach, and rectum.

In another aspect, the present disclosure provides a method of treating cancer in a human wherein the cancer is associated with over-expression of a TAA. The method comprises administering to the human an effective amount of immunogenic TAA composition capable of eliciting an immune response against the over-expressed TAA. The immunogenic TAA composition may be (1) an immunogenic TAA polypeptide, (2) an isolated nucleic acid molecule encoding one or more immunogenic TAA polypeptides, (3) a composition comprising an immunogenic TAA polypeptide, or (4) a composition comprising an isolated nucleic acid molecule encoding one or more immunogenic TAA polypeptides.

In some embodiments, the disclosure provides a method of treating a cancer in a human, comprising administering to the human an effective amount of a nucleic acid composition provided herein above. The nucleic acids in the composition may be a single-antigen construct encoding only one particular immunogenic TAA polypeptide, such as an immunogenic MSLN polypeptide, an immunogenic MUC1 polypeptide, or an immunogenic TERT polypeptide. The nucleic acids in the composition may also be a multi-antigen construct encoding two, three, or more different immunogenic TAA polypeptides. In some specific embodiments, the disclosure provides a method of treating a cancer in a human, comprising administering to the human an effective amount of a composition comprising a dual-antigen construct. The dual-antigen construct may encode any two different immunogenic TAA polypeptides selected from: (1) an immunogenic MSLN polypeptide and an immunogenic MUC1 polypeptide; (2) an immunogenic MSLN polypeptide and an immunogenic TERT polypeptide; (3) an immunogenic TERT polypeptide and an immunogenic MUC1 polypeptide.

In some other specific embodiments, the disclosure provides a method of treating a cancer in a human, wherein the cancer is associated with over-expression of one or more TAAs selected from MUC1, MSLN, and TERT, which method comprises administering to the human an effective amount of a composition comprising a triple-antigen construct encoding an immunogenic MSLN polypeptide, an immunogenic MUC1 polypeptide, and an immunogenic TERT polypeptide.

Any cancer that over-expresses the tumor-associate antigen MUC1, MSLN, and/or TERT may be treated by a method provided by the present disclosure. Examples of cancers include breast cancer, ovarian cancer, lung cancer (such as small cell lung cancer and non-small cell lung cancer), colorectal cancer, gastric cancer, and pancreatic cancer. In some particular embodiments, the present disclosure provide a method of treating cancer in a human, which comprises administering to the human an effective amount of a composition comprising a triple-antigen construct, wherein the cancer is (1) breast cancer, such as triple-negative breast cancer, (2) pancreatic cancer, such as pancreatic ductal adenocarcinoma, or (3) ovarian cancer, such as ovarian adenocarcinoma.

The polypeptide and nucleic acid compositions can be administered to a subject, including human (such as a human patient), by a number of suitable methods known in the art. Examples of suitable methods include: (1) intramuscular, intradermal, intraepidermal, or subcutaneous administration, (2) oral administration, and (3) topical application (such as ocular, intranasal, and intravaginal application). One particular method of intradermal or intraepidermal administration of a nucleic acid composition that may be used is gene gun delivery using the Particle Mediated Epidermal Delivery (PMED™) DNA delivery device marketed by PowderMed. PMED is a needle-free method of administering DNAs to animals or humans. The PMED system involves the precipitation of DNA onto microscopic gold particles that are then propelled by helium gas into the epidermis. The DNA-coated gold particles are delivered to the APCs and keratinocytes of the epidermis, and once inside the nuclei of these cells, the DNA elutes off the gold and becomes transcriptionally active, producing encoded protein. One particular method for intramuscular administration of a nucleic acid composition is electroporation. Electroporation uses controlled electrical pulses to create temporary pores in the cell membrane, which facilitates cellular uptake of the nucleic acid composition injected into the muscle. Where a CpG is used in combination with a nucleic acid composition, the CpG and nucleic acid composition may be co-formulated in one formulation and the formulation is administered intramuscularly by electroporation.

The effective amount of the immunogenic TAA polypeptide or nucleic acid encoding an immunogenic TAA polypeptide in the composition to be administered to a subject, such as human patient, a given method provided by the present disclosure can be readily determined by a person skilled in the art and will depend on a number of factors. In a method of treating cancer, such as pancreatic cancer, ovarian cancer, and breast cancer, factors that may be considered in determining the effective amount of the immunogenic TAA polypeptide or nucleic acid include, but not limited: (1) the subject to be treated, including the subject's immune status and health, (2) the severity or stage of the cancer to be treated, (3) the specific immunogenic TAA polypeptides used or expressed, (4) the degree of protection or treatment desired, (5) the administration method and schedule, and (6) other therapeutic agents (such as adjuvants or immune modulators) used. In the case of nucleic acid vaccine compositions, including the multi-antigen vaccine compositions, the method of formulation and delivery are among the key factors for determining the dose of the nucleic acid required to elicit an effective immune response. For example, the effective amounts of the nucleic acid may be in the range of 2 µg/dose-10 mg/dose when the nucleic acid vaccine composition is formulated as an aqueous solution and administered by hypodermic needle injection or pneumatic injection, whereas only 16 ng/dose-16 µg/dose may be required when the nucleic acid is prepared as coated gold beads and delivered using a gene gun technology. The dose range for a nucleic acid vaccine by electroporation is generally in the range of 0.5-10 mg/dose. In the case where the nucleic acid vaccine is administered together with a CpG by electroporation in a co-formulation, the dose of the nucleic acid vaccine may be in the range of 0.5-5 mg/dose and the dose of CpG is typically in the range of 0.05 mg-5 mg/dose, such as 0.05, 0.2, 0.6, or 1.2 mg/dose per person. The nucleic acid or polypeptide vaccine compositions of the present invention can be used in a prime-boost strategy to induce robust and long-lasting immune response. Priming and boosting vaccination protocols based on repeated injections of the same immunogenic construct are well known. In general, the first dose may not produce protective immunity, but only "primes" the immune system. A protective immune response develops after the second or third dose (the "boosts"). The boosts are performed according to conventional techniques, and can be further optimized empirically in terms of schedule of administration, route of administration, choice of adjuvant, dose, and potential sequence when administered with another vaccine. In one embodiment, the nucleic acid or polypeptide vaccines of the present invention are used in a conventional homologous prime-boost strategy, in which the same vaccine is administered to the animal in multiple doses. In another embodiment, the nucleic acid or polypeptide vaccine compositions are used in a heterologous prime-boost vaccination, in which different types of vaccines containing the same antigens are administered at predetermined time intervals. For example, a nucleic acid construct may be administered in the form of a plasmid in the initial dose ("prime") and as part of a vector in the subsequent doses ("boosts"), or vice versa.

The polypeptide or nucleic acid immunogenic compositions of the present disclosure may be used together with one or more adjuvants. Examples of suitable adjuvants include: (1) oil-in-water emulsion formulations (with or without other specific immunostimulating agents such as muramyl polypeptides or bacterial cell wall components), such as (a) MF59™ (PCT Publication No. WO 90/14837; Chapter 10 in *Vaccine design: the subunit and adjuvant approach*, eds. Powell & Newman, Plenum Press 1995), containing 5% Squalene, 0.5% Tween 80 (polyoxyethylene sorbitan monooleate), and 0.5% Span 85 (sorbitan trioleate) formulated into submicron particles using a microfluidizer, (b) SAF, containing 10% Squalene, 0.4% Tween 80, 5% pluronic-blocked polymer L121, and thr-MDP either microfluidized into a submicron emulsion or vortexed to generate a larger particle size emulsion, and (c) RIBI™ adjuvant system (RAS) (Ribi Immunochem, Hamilton, Mont.) containing 2% Squalene, 0.2% Tween 80, and one or more bacterial cell wall components such as monophosphorylipid A (MPL), trehalose dimycolate (TDM), and cell wall skeleton (CWS), (2) saponin adjuvants, such as QS21, STIMULON™ (Cambridge Bioscience, Worcester, Mass.), Abisco® (Isconova, Sweden), or Iscomatrix® (Commonwealth Serum Laboratories, Australia); (3) Complete Freund's Adjuvant (CFA) and Incomplete Freund's Adjuvant (IFA); (4) cytokines, such as interleukins (e.g. IL-1, IL-2, IL-4, IL-5, IL-6, IL-7, IL-12 (PCT Publication No. WO 99/44636), etc.), interferons (e.g. gamma interferon), macrophage colony stimulating factor (M-CSF), and tumor necrosis factor (TNF); (5) monophosphoryl lipid A (MPL) or 3-O-deacylated MPL (3dMPL), (WO 00/56358); (6) combinations of 3dMPL with QS21 and/or oil-in-water emulsions (EP-A-0835318, EP-A-0735898, EP-A-0761231); (7) oligonucleotides comprising CpG motifs, i.e. containing at least one CG dinucleotide, where the cytosine is unmethylated (WO 98/40100, WO 98/55495, WO 98/37919 and WO 98/52581); (8) a polyoxyethylene ether or a polyoxyethylene ester (WO 99/52549); (9) a polyoxyethylene sorbitan ester surfactant in combination with an octoxynol (WO 01/21207) or a polyoxyethylene alkyl ether or ester surfactant in combination with at least one additional non-ionic surfactant such as an octoxynol (WO 01/21152); (10) a saponin and an immunostimulatory oligonucleotide (e.g. a CpG oligonucleotide) (WO 00/62800); (11) metal salt, including aluminum salts (also known as alum), such as aluminum phosphate and aluminum hydroxide; (12) a saponin and an oil-in-water emulsion (WO 99/11241); and (13) a combination of saponin (e.g. QS21), 3dMPL, and IM2 (WO 98/57659).

Further, for the treatment of a neoplastic disorder, including a cancer, in a subject, such as a human patient, the polypeptide or nucleic acid compositions, including vaccine compositions, provided by the present disclosure may be administered in combination with one or more immune modulators. The immune modulator may be an immune-suppressive-cell inhibitor (ISC inhibitor) or an immune-effector-cell enhancer (IEC enhancer). Further, one or more ISC inhibitors may be used in combination with one or more IEC enhancers. The immune modulators may be administered by any suitable methods and routes, including (1) systemic administration such as intravenous, intramuscular, or oral administration, and (2) local administration such intradermal and subcutaneous administration. Where appropriate or suitable, local administration is generally preferred over systemic administration. Local administration of any immune modulators can be carried out at any location of the body of the subject that is suitable for local administration of pharmaceuticals; however, it is more preferable that these immune modulators are administered locally at close proximity to the vaccine draining lymph node.

The compositions, such as a vaccine, may be administered simultaneously or sequentially with any or all of the immune modulators used. Similarly, when two or more immune modulators are used, they may be administered simultaneously or sequentially with respect to each other. In some embodiments, a vaccine is administered simultaneously (e.g., in a mixture) with respect to one immune modulator, but sequentially with respect to one or more additional immune modulators. Co-administration of the vaccine and the immune modulators can include cases in which the vaccine and at least one immune modulator are administered so that each is present at the administration site, such as vaccine draining lymph node, at the same time, even though the antigen and the immune modulators are not administered simultaneously. Co-administration of the vaccine and the immune modulators also can include cases in which the vaccine or the immune modulator is cleared from the administration site, but at least one cellular effect of the cleared vaccine or immune modulator persists at the administration site, such as vaccine draining lymph node, at least until one or more additional immune modulators are administered to the administration site. In cases where a nucleic acid vaccine is administered in combination with a CpG, the vaccine and CpG may be contained in a single formulation and administered together by any suitable method. In some embodiments, the nucleic acid vaccine and CpG in a co-formulation (mixture) is administered by intramuscular injection in combination with electroporation.

In some embodiments, the immune modulator that is used in combination with the polypeptide or nucleic acid composition is an ISC inhibitor. Examples of SIC inhibitors include (1) protein kinase inhibitors, such as imatinib, sorafenib, lapatinib, BIRB-796, and AZD-1152, AMG706, Zactima (ZD6474), MP-412, sorafenib (BAY 43-9006), dasatinib, CEP-701 (lestaurtinib), XL647, XL999, Tykerb (lapatinib), MLN518, (formerly known as CT53518), PKC412, ST1571, AEE 788, OSI-930, OSI-817, sunitinib malate (SUTENT), axitinib (AG-013736), erlotinib, gefitinib, axitinib, bosutinib, temsirolismus and nilotinib (AMN107). In some particular embodiments, the tyrosine kinase inhibitor is sunitinib, sorafenib, or a pharmaceutically acceptable salt or derivative (such as a malate or a tosylate) of sunitinib or sorafenib; (2) cyclooxygenase-2 (COX-2) inhibitors, such as celecoxib and rofecoxib; (3) phosphodiesterase type 5 (PDES) inhibitors, such as Examples of PDES inhibitors include avanafil, lodenafil, mirodenafil, sildenafil, tadalafil, vardenafil, udenafil, and zaprinast, and (4) DNA crosslinkers, such as cyclophosphamide.

In some embodiments, the immune modulator that is used in combination with the polypeptide or nucleic acid composition is an IEC enhancer. Two or more IEC enhancers may be used together. Examples of IEC enhancers that may be used include: (1) TNFR agonists, such as agonists of OX40, 4-1BB (such as BMS-663513), GITR (such as TRX518), and CD40 (such as CD40 agonistic antibodies); (2) CTLA-4 inhibitors, such as is Ipilimumab and Tremelimumab; (3) TLR agonists, such as CpG 7909 (5' TCGTCGTTTTGTCGTTTTGTCGTT3') (SEQ ID NO:630), CpG 24555 (5' TCGTCGTTTTTCGGT-GCTTTT3') (SEQ ID NO:631); and CpG 10103 (5' TCGTCGTTTTTCGGTCGTTTT3') (SEQ ID NO:632); (4) programmed cell death protein 1 (PD-1) inhibitors, such as nivolumab and pembrolizumab; and (5) PD-L1 inhibitors, such as atezolizumab, durvalumab, and velumab; and (6) IDO1 inhibitors. In some embodiments, the IEC enhancer is CD40 agonist antibody, which may be a human, humanized or part-human chimeric anti-CD40 antibody. Examples of specific CD40 agonist antibodies include the G28-5, mAb89, EA-5 or S2C6 monoclonal antibody, and CP870, 893. CP-870,893 is a fully human agonistic CD40 monoclonal antibody (mAb) that has been investigated clinically as an anti-tumor therapy. The structure and preparation of CP870,893 is disclosed in WO2003041070 (where the antibody is identified by the internal identified "21.4.1" and the amino acid sequences of the heavy chain and light chain of the antibody are set forth in SEQ ID NO: 40 and SEQ ID NO: 41, respectively). For use in combination with a composition present disclosure, CP-870,893 may be administered by any suitable route, such as intradermal, subcutaneous, or intramuscular injection. The effective amount of CP870893 is generally in the range of 0.01-0.25 mg/kg. In some embodiment, CP870893 is administered at an amount of 0.05-0.1 mg/kg.

In some other embodiments, the IEC enhancer is a CTLA-4 inhibitor, such as Ipilimumab and Tremelimumab. Ipilimumab (also known as MEX-010 or MDX-101), marketed as YERVOY, is a human anti-human CTLA-4 antibody. Ipilimumab can also be referred to by its CAS Registry No. 477202-00-9, and is disclosed as antibody 10DI in PCT Publication No. WO 01/14424. Tremelimumab (also known as CP-675,206) is a fully human IgG2 monoclonal antibody and has the CAS number 745013-59-6. Tremelimumab is disclosed in U.S. Pat. No. 6,682,736, incorporated herein by reference in its entirety, where it is identified as antibody 11.2.1 and the amino acid sequences of its heavy chain and light chain are set forth in SEQ ID NOs:42 and 43, respectively. For use in combination with a composition provided by the present disclosure, Tremelimumab may be administered locally, particularly intradermally or subcutaneously. The effective amount of Tremelimumab administered intradermally or subcutaneously is typically in the range of 5-200 mg/dose per person. In some embodiments, the effective amount of Tremelimumab is in the range of 10-150 mg/dose per person per dose. In some particular embodiments, the effective amount of Tremelimumab is about 10, 25, 50, 75, 100, 125, 150, 175, or 200 mg/dose per person.

In some other embodiments, the immune modulator is a PD-1 inhibitor or PD-L1 inhibitor, such as nivolumab, pembrolizumab, RN888 (anti-PD-1 antibody), Atezolizumab (PD-L1-specific mAbs from Roche), Durvalumab (PD-L1-specific mAbs from Astra Zeneca), and Avelumab (PD-L1-specific mAbs from Merck). (Okazaki T et al., International Immunology (2007), 19, 7:813-824, Sunshine J et al., Curr Opin Pharmacol. 2015 August; 23:32-8).

In other embodiments, the present disclosure provides use of an immune modulator with a vaccine, including anti-cancer vaccines, wherein the immune modulator is an inhibitor of indoleamine 2,3-dioxygenase 1 (also known as "IDO1"). IDO1 was found to modulate immune cell function to a suppressive phenotype and was, therefore, believed to partially account for tumor escape from host immune surveillance. The enzyme degrades the essential amino acid tryptophan into kynurenine and other metabolites. It was found that these metabolites and the paucity of tryptophan leads to suppression of effector T-cell function and augmented differentiation of regulatory T cells. The 001 inhibitors may be large molecules, such as an antibody, or a small molecule, such as a chemical compound.

In some particular embodiments, the polypeptide or nucleic acid composition provided by the present disclosure is used in combination with a 1,2,5-oxadiazole derivative 001 inhibitor disclosed in WO2010/005958. Examples of specific 1,2,5-oxadiazole derivative IDO1 inhibitors include the following compounds:

4-({2-[(aminosulfonyl)amino]ethyl}amino)-N-(3-bromo-4-fluorophenyl)-N'-hydroxy-1,2,5-oxadiazole-3-carboximidamide 4-({2 [(aminosulfonyl)amino]ethyl} amino)-N-(3-chloro-4-fluorophenyl)-N'-hydroxy-1,2,5-oxadiazole 3-carboximidamide;

4-({2 [(aminosulfonyl)amino] ethyl} amino)-N-[4-fluoro-3-(trifluoromethyl)phenyl]-N'-hydroxy-1,2,5 oxadiazole-3-carboximidamide;

4-({2 [(aminosulfonyl)amino] ethyl} amino)-N'-hydroxy-N-[3-(trifluoromethyl)phenyl]-1,2,5 oxadiazole-3-carboximidamide;

4-({2 [(aminosulfonyl)amino]ethyl} amino)-N-(3-cyano-4-fluorophenyl)-N'-hydroxy-1,2,5-oxadiazole 3-carboximidamide;

4-({2 [(aminosulfonyl)amino] ethyl} amino)-N-[(4-bromo-2-furyl)methyl]-N'-hydroxy-1,2,5 oxadiazole-3-carboximidamide; or 4-({2 [(aminosulfonyl)amino] ethyl} amino)-N-[(4-chloro-2-furyl)methyl]-N'-hydroxy-1,2,5 oxadiazole-3-carboximidamide.

The 1,25-oxadiazole derivative IDO1 inhibitors are typically administered orally once or twice per day and effective amount by oral administration is generally in the range of 25 mg-1000 mg per dose per patient, such as 25 mg, 50 mg, 100 mg, 200 mg, 300 mg, 400 mg, 500 mg, 600 mg, 700 mg, 800 mg, or 1000 mg. In a particular embodiment, the polypeptide or nucleic acid composition provided by the present disclosure is used in combination with 4-({2-[(aminosulfonyl)amino]ethyl}amino)-N-(3-bromo-4-fluorophenyl)-N'-hydroxy-1,2,5-oxadiazole-3-carboximidamide administered orally twice per day at 25 mg or 50 mg per dose. The 1,2,5-oxadiazole derivatives may be synthesized as described in U.S. Pat. No. 8,088,803, which is incorporated herein by reference in its entirety.

In some other specific embodiments, the polypeptide or nucleic acid composition provided by the present disclosure is used in combination with a pyrrolidine-2,5-dione derivative IDO1 inhibitor disclosed in WO2015/173764. Examples of specific pyrrolidine-2,5-dione derivative inhibitors include the following compounds:

3-(5-fluoro-1H-indol-3-yl)pyrrolidine-2,5-dione, (3-$^2$H)-3-(5-fluoro-1H-indol-3-yl)pyrrolidine-2,5-dione;

(−)-(R)-3-(5-fluoro-1H-indol-3-yl)pyrrolidine-2,5-dione, 3-(1H-indol-3-yl)pyrrolidine-2,5-dione, (−)-(R)-3-(1H-indol-3-yl)pyrrolidine-2,5-dione, 3-(5-chloro-1H-indol-3-yl)pyrrolidine-2,5-dione;

(−)-(R)-3-(5-chloro-1H-indol-3-yl)pyrrolidine-2,5-dione, 3-(5-bromo-1H-indol-3-yl)pyrrolidine-2,5-dione, 3-(5,6-difluoro-1H-indol-3-yl)pyrrolidine-2,5-dione; and 3-(6-chloro-1H-indol-3-yl)pyrrolidine-2,5-dione.

The pyrrolidine-2,5-dione derivative IDO1 inhibitors are typically admininstered orally once or twice per day and the effective amount by oral administration is generally in the range of 50 mg-1000 mg per dose per patient, such as 125 mg, 250 mg, 500 mg, 750 mg, or 1000 mg. In a particular embodiment, the polypeptide or nucleic acid composition provided by the present disclosure is used in combination with 3-(5-fluoro-1H-indol-3-yl)pyrrolidine-2,5-dione administered orally once per day at 125-100 mg per dose per patient. The pyrrolidine-2,5-dione derivatives may be synthesized as described in U.S. patent application publication US2015329525, which is incorporated herein by reference in its entirety.

H. Examples

The following examples are provided to illustrate certain embodiments of the invention. They should not be construed to limit the scope of the invention in any way. From the above description and these examples, one skilled in the art can ascertain the essential characteristics of the invention, and without departing from the spirit and scope thereof, can make various changes and modifications of the invention to adapt it to various usage and conditions.

Example 1. Construction of Single-Antigen, Dual-Antigen, and Triple-Antigen Constructs Example 1 illustrates the construction of single antigen constructs, dual-antigen constructs, and triple antigen constructs. Unless as otherwise noted, reference to amino acid positions or residues of MUC1, MSLN, and TERT protein refers to the amino acid sequence of human MUC1 isoform 1 precursor protein as set forth in SEQ ID NO:1, amino acid sequence of human mesothelin (MSLN) isoform 2 precursor protein as set forth in SEQ ID NO:2, and the amino acid sequence of human TERT isoform 1 precursor protein as set forth in SEQ ID NO:3, respectively.

1A. Single-Antigen Constructs

Plasmid 1027 (MUC1).

Plasmid 1027 was generated using the techniques of gene synthesis and restriction fragment exchange. The amino acid sequence of human MUC1 with a 5× tandem repeat VNTR region was submitted to GeneArt for gene optimization and synthesis. The gene encoding the polypeptide was optimized for expression, synthesized, and cloned. The MUC-1 open reading frame was excised from the GeneArt vector by digestion with NheI and BglII and inserted into similarly digested plasmid pPJV7563. The open reading frame (ORF) nucleotide sequence of Plasmid 1027 is set forth in SEQ ID NO:7. The amino acid sequence encoded by Plasmid 1027 is set for in SEQ ID NO:8.

Plasmid 1103 (cMSLN).

Plasmid 1103 was constructed using the techniques of PCR and restriction fragment exchange. First, the gene encoding the mesothelin precursor amino acids 37-597 was amplified by PCR from plasmid 1084 with primers MSLN34 and MSLN598, resulting in the addition of NheI and BglII restriction sites at the 5' and 3' ends of the amplicon, respectively. The amplicon was digested with NheI and Bgl II and inserted into similarly digested plasmid pPJV7563. The open reading frame nucleotide sequence of Plasmid 1103 is set forth in SEQ ID NO:5. The amino acid sequence encoded by Plasmid 1103 is set for in SEQ ID NO:6.

Plasmid 1112 (TERT240).

Plasmid 1112 was constructed using the techniques of PCR and Seamless cloning. First, the gene encoding TERT amino acids 241-1132 was amplified by PCR from plasmid 1065 with primers f pmed TERT 241G and r TERT co# pMed. The amplicon was cloned into the Nhe I/Bgl II sites of pPJV7563 by Seamless cloning. The open reading frame nucleotide sequence of Plasmid1112 is set forth in SEQ ID NO:9. The amino acid sequence encoded by Plasmid 1112 is set for in SEQ ID NO:10.

Plasmid 1197 (cMUC1).

Plasmid 1197 was constructed using the techniques of PCR and Seamless cloning. First, the gene encoding MUC1 amino acids 22-225, 946-1255 was amplified by PCR from plasmid 1027 with primers ID1197F and ID1197R. The amplicon was cloned into the Nhe I/Bgl II sites of pPJV7563 by Seamless cloning. The open reading frame nucleotide sequence of Plasmid 1197 is set forth in SEQ ID NO:15. The amino acid sequence encoded by Plasmid 1197 is set for in SEQ ID NO:16.

Plasmid 1326 (TERT343).

Plasmid 1326 was constructed using the techniques of PCR and Seamless cloning. First, the gene encoding TERT amino acids 344-1132 was amplified by PCR from plasmid 1112 with primers TertA343-F and Tert-R. The amplicon was cloned into the Nhe I/Bgl II sites of pPJV7563 by Seamless cloning. The open reading frame nucleotide sequence of Plasmid1326 is set forth in SEQ ID NO:13. The amino acid sequence encoded by Plasmid 1326 is set for in SEQ ID NO:14.

Plasmid 1330 (TERT541).

Plasmid 1330 was constructed using the techniques of PCR and Seamless cloning. First, the gene encoding TERT amino acids 542-1132 was amplified by PCR from plasmid 1112 with primers TertA541-F and Tert-R. The amplicon was cloned into the Nhe I/Bgl II sites of pPJV7563 by Seamless cloning. The open reading frame nucleotide sequence of Plasmid 1330 is set forth in SEQ ID NO:11. The amino acid sequence encoded by Plasmid 1330 is set for in SEQ ID NO:12.

1B. Dual-Antigen Constructs

Plasmid 1158 (cMSLN-PT2A-Muc1).

Plasmid 1158 was constructed using the techniques of PCR and Seamless cloning. First, the gene encoding the mesothelin precursor amino acids 37-597 was amplified by PCR from plasmid 1103 with primers f pmed Nhe cMSLN and r PTV2A Bamh cMSLN. The gene encoding human Mucin-1 amino acids 2-225, 946-1255 was amplified by PCR from plasmid 1027 with primers f1 PTV2A Muc, f2 PTV2A, and r pmed Bgl Muc. PCR resulted in the addition of overlapping PTV 2A sequences at the 3' end of cMSLN and 5' end of Mud. The amplicons were mixed together and cloned into the Nhe I/Bgl II sites of pPJV7563 by Seamless cloning. The open reading frame nucleotide sequence of Plasmid 1158 is set forth in SEQ ID NO:23. The amino acid sequence encoded by Plasmid 1158 is set for in SEQ ID NO:24.

Plasmid 1159 (Muc1-PT2A-cMSLN).

Plasmid 1159 was constructed using the techniques of PCR and Seamless cloning. First, the gene encoding the mesothelin precursor amino acids 37-597 was amplified by PCR from plasmid 1103 with primers f1 PTV2A cMSLN, f2 PTV2A, and r pmed Bgl cMSLN. The gene encoding human Mucin-1 amino acids 2-225, 946-1255 was amplified by PCR from plasmid 1027 with primers f pmed Nhe Muc and r PTV2A Bamh Muc. PCR resulted in the addition of overlapping PTV 2A sequences at the 5' end of cMSLN and 3' end of Mud. The amplicons were mixed together and cloned into the Nhe I/Bgl II sites of pPJV7563 by Seamless cloning. The open reading frame nucleotide sequence of Plasmid 1159 is set forth in SEQ ID NO:21. The amino acid sequence encoded by Plasmid 1159 is set for in SEQ ID NO:22.

Plasmid 1269 (Muc1-Ter240).

Plasmid 1269 was constructed using the techniques of PCR and Seamless cloning. First, the gene encoding the human telomerase amino acids 241-1132 was amplified by PCR from plasmid 1112 with primers f tg link Ter240 and r pmed Bgl Ter240. The gene encoding human Mucin-1 amino acids 2-225, 946-1255 was amplified by PCR from plasmid 1027 with primers f pmed Nhe Muc and r link muc. PCR resulted in the addition of an overlapping GGSGG linker at the 5' end of Tert and 3' end of Mud. The amplicons were mixed together and cloned into the Nhe I/Bgl II sites of pPJV7563 by Seamless cloning. The open reading frame nucleotide sequence of Plasmid 1269 is set forth in SEQ ID NO:25. The amino acid sequence encoded by Plasmid 1269 is set for in SEQ ID NO:26.

Plasmid 1270 (Muc1-ERB2A-Ter240).

Plasmid 1270 was constructed using the techniques of PCR and Seamless cloning. First, the gene encoding the human telomerase amino acids 241-1132 was amplified by PCR from plasmid 1112 with primers f2 ERBV2A, f1 ERBV2A Ter240, and r pmed Bgl Ter240. The gene encoding human Mucin-1 amino acids 2-225, 946-1255 was amplified by PCR from plasmid 1027 with primers f pmed Nhe Muc and r ERB2A Bamh Muc. PCR resulted in the addition of overlapping ERBV 2A sequences at the 5' end of Tert and 3' end of Muc1. The amplicons were mixed together and cloned into the Nhe I/Bgl II sites of pPJV7563 by Seamless cloning. The open reading frame nucleotide sequence of Plasmid 1270 is set forth in SEQ ID NO:27. The amino acid sequence encoded by Plasmid 1270 is set for in SEQ ID NO:28.

Plasmid 1271 (Ter240-ERB2A-Muc1).

Plasmid 1271 was constructed using the techniques of PCR and Seamless cloning. First, the gene encoding the human telomerase amino acids 241-1132 was amplified by PCR from plasmid 1112 with primers f pmed Nhe Ter240 and r ERB2A Bamh Ter240. The gene encoding human Mucin-1 amino acids 2-225, 946-1255 was amplified by PCR from plasmid 1027 with primers f2 ERBV2A, f1 ERBV2A Muc, and r pmed Bgl Muc. PCR resulted in the addition of overlapping ERBV 2A sequences at the 3' end of Tert and 5' end of Muc1. The amplicons were mixed together and cloned into the Nhe I/Bgl II sites of pPJV7563 by Seamless cloning. The open reading frame nucleotide sequence of Plasmid 1271 is set forth in SEQ ID NO:29. The amino acid sequence encoded by Plasmid 1271 is set for in SEQ ID NO:30.

Plasmid 1272 (Ter240-T2A-cMSLN).

Plasmid 1272 was constructed using the techniques of PCR and Seamless cloning. First, the gene encoding the human telomerase amino acids 241-1132 was amplified by PCR from plasmid 1112 with primers f pmed Nhe Ter240 and r T2A Tert240. The gene encoding the mesothelin precursor amino acids 37-597 was amplified by PCR from plasmid 1103 with primers f2 T2A, f1 T2A cMSLN, and r pmed Bgl cMSLN. PCR resulted in the addition of overlapping TAV 2A sequences at the 3' end of Tert and 5' end of cMSLN. The amplicons were mixed together and cloned into the Nhe I/Bgl II sites of pPJV7563 by Seamless cloning. The open reading frame nucleotide sequence of Plasmid 1272 is set forth in SEQ ID NO:35. The amino acid sequence encoded by Plasmid 1272 is set for in SEQ ID NO:36.

Plasmid 1273 (Tert240-cMSLN).

Plasmid 1273 was constructed using the techniques of PCR and Seamless cloning. First, the gene encoding the human telomerase amino acids 241-1132 was amplified by PCR from plasmid 1112 with primers f pmed Nhe Ter240 and r link Tert240. The gene encoding the mesothelin precursor amino acids 37-597 was amplified by PCR from plasmid 1103 with primers f tert ink cMSLN and r pmed Bgl cMSLN. PCR resulted in the addition of an overlapping GGSGG linker at the 3' end of Tert and 5' end of cMSLN. The amplicons were mixed together and cloned into the Nhe I/Bgl II sites of pPJV7563 by Seamless cloning. The open reading frame nucleotide sequence of Plasmid 1273 is set forth in SEQ ID NO:37. The amino acid sequence encoded by Plasmid 1273 is set for in SEQ ID NO:38.

Plasmid 1274 (cMSLN-T2A-Tert240).

Plasmid 1274 was constructed using the techniques of PCR and Seamless cloning. First, the gene encoding the human telomerase amino acids 241-1132 was amplified by PCR from plasmid 1112 with primers f2 T2A, f1 T2A Tert240 and r pmed Bgl Ter240. The gene encoding the mesothelin precursor amino acids 37-597 was amplified by PCR from plasmid 1103 with primers f pmed Nhe cMSLN and r T2A Bamh cMSLN. PCR resulted in the addition of overlapping TAV 2A sequences at the 5' end of Tert and 3' end of cMSLN. The amplicons were mixed together and cloned into the Nhe I/Bgl II sites of pPJV7563 by Seamless cloning. The open reading frame nucleotide sequence of Plasmid 1274 is set forth in SEQ ID NO:39. The amino acid sequence encoded by Plasmid 1274 is set for in SEQ ID NO:40.

Plasmid 1275 (cMSLN-Tert240).

Plasmid 1275 was constructed using the techniques of PCR and Seamless cloning. First, the gene encoding human telomerase amino acids 241-1132 was amplified by PCR from plasmid 1112 with primers f tg link Ter240 and r pmed Bgl Ter240. The gene encoding the mesothelin precursor amino acids 37-597 was amplified by PCR from plasmid 1103 with primers f pmed Nhe cMSLN and r link cMSLN. PCR resulted in the addition of an overlapping GGSGG linker at the 5' end of Tert and 3' end of cMSLN. The amplicons were mixed together and cloned into the Nhe I/Bgl II sites of pPJV7563 by Seamless cloning. The open reading frame nucleotide sequence of Plasmid 1275 is set forth in SEQ ID NO:41. The amino acid sequence encoded by Plasmid 1275 is set for in SEQ ID NO:42.

Plasmid 1286 (cMuc1-ERB2A-Tert240).

Plasmid 1286 was constructed using the techniques of PCR and Seamless cloning. First, the gene encoding the human telomerase amino acids 241-1132 was amplified by PCR from plasmid 1112 with primers f2 ERBV2A, f1 ERBV2A Ter240, and r pmed Bgl Ter240. The gene encoding human Mucin-1 amino acids 22-225, 946-1255 was amplified by PCR from plasmid 1197 with primers f pmed Nhe cytMuc and r ERB2A Bamh Muc. PCR resulted in the addition of overlapping ERBV 2A sequences at the 5' end of Tert and 3' end of Muc1.

The amplicons were mixed together and cloned into the Nhe I/Bgl II sites of pPJV7563 by Seamless cloning. The open reading frame nucleotide sequence of Plasmid 1286 is set forth in SEQ ID NO:31. The amino acid sequence encoded by Plasmid 1286 is set for in SEQ ID NO:32.

Plasmid 1287 (Tert240-ERB2A-cMuc1).

Plasmid 1287 was constructed using the techniques of PCR and Seamless cloning. First, the gene encoding the human telomerase amino acids 241-1132 was amplified by PCR from plasmid 1112 with primers f pmed Nhe Ter240 and r ERB2A Bamh Ter240. The gene encoding human Mucin-1 amino acids 22-225, 946-1255 was amplified by PCR from plasmid 1197 with primers f2 ERBV2A, f1 ERBV2A cMuc, and r pmed Bgl Muc. PCR resulted in the addition of overlapping ERBV 2A sequences at the 3' end of Tert and 5' end of Muc1. The amplicons were mixed together and cloned into the Nhe I/Bgl II sites of pPJV7563 by Seamless cloning. The open reading frame nucleotide sequence of Plasmid 1287 is set forth in SEQ ID NO:33. The amino acid sequence encoded by Plasmid 1287 is set for in SEQ ID NO: 34.

Plasmid 1313 (Muc1-EMC2A-cMSLN).

Plasmid 1313 was constructed using the techniques of PCR and Seamless cloning. First, the gene encoding the mesothelin precursor amino acids 37-597 was amplified by PCR from plasmid 1103 with primers EMCV_cMSLN_F—33, EMCV2A_F-34 and pMED_cMSLN_R-37. The gene encoding human Mucin-1 amino acids 2-225, 946-1255 was amplified by PCR from plasmid 1027 with primers pMED_MUC1_F-31, EMCV2A_R-36, and EMCV_Muc1_R-35. PCR resulted in the addition of overlapping EMCV 2A sequences at the 5' end of cMSLN and 3' end of Mud. The amplicons were mixed together and cloned into the Nhe I/Bgl II sites of pPJV7563 by Seamless cloning. The open reading frame nucleotide sequence of Plasmid 1313 is set forth in SEQ ID NO:19. The amino acid sequence encoded by Plasmid 1313 is set for in SEQ ID NO:20.

Plasmid 1316 (cMSLN-EMC2A-Muc1).

Plasmid 1316 was constructed using the techniques of PCR and Seamless cloning. First, the gene encoding the human mesothelin precursor amino acids 37-597 was amplified by PCR from plasmid 1103 with primers f pmed Nhe cMSLN and r EM2A Bamh cMSLN. The gene encoding human Mucin-1 amino acids 2-225, 946-1255 was amplified by PCR from plasmid 1027 with primers f1 EM2A Muc, f2 EMCV2A, and r pmed Bgl Muc. PCR resulted in the addition of overlapping EMCV 2A sequences at the 3' end of cMSLN and 5' end of Mud. The amplicons were mixed together and cloned into the Nhe I/Bgl II sites of pPJV7563 by Seamless cloning. The open reading frame nucleotide sequence of Plasmid 1316 is set forth in SEQ ID NO:17. The amino acid sequence encoded by Plasmid 1316 is set for in SEQ ID NO:18.

1C. Triple-Antigen Constructs

Plasmid 1317 (Muc1-EMC2A-cMSLN-T2A-Tert240).

Plasmid 1317 was constructed using the techniques of PCR and Seamless cloning. First, the genes encoding human Mucin-1 amino acids 2-225, 946-1255, an EMCV 2A peptide, and the amino terminal half of the mesothelin precursor were amplified by PCR from plasmid 1313 with primers f pmed Nhe Muc and r MSLN 1051-1033. The genes encoding the carboxy terminal half of the mesothelin precursor, a TAV 2A peptide, and human telomerase amino acids 241-1132 were amplified by PCR from plasmid 1274 with primers f MSLN 1028-1051 and r pmed Bgl Ter240. The partially overlapping amplicons were digested with Dpn I, mixed together, and cloned into the Nhe I/Bgl II sites of pPJV7563 by Seamless cloning. The open reading frame nucleotide sequence of Plasmid 1317 is set forth in SEQ ID NO:43. The amino acid sequence encoded by Plasmid 1317 is set for in SEQ ID NO:44.

Plasmid 1318 (Muc1-ERB2A-Tert240-T2A-cMSLN).

Plasmid 1318 was constructed using the techniques of PCR and Seamless cloning. First, the genes encoding human Mucin-1 amino acids 2-225, 946-1255, an ERBV 2A peptide, and the amino terminal half of human telomerase were amplified by PCR from plasmid 1270 with primers f pmed Nhe Muc and r tert 1602-1579. The genes encoding the carboxy terminal half of telomerase, a TAV 2A peptide, and human mesothelin precursor amino acids 37-597 were amplified by PCR from plasmid 1272 with primers f tert 1584-1607 and r pmed Bgl cMSLN. The partially overlapping amplicons were digested with Dpn I, mixed together, and cloned into the Nhe I/Bgl II sites of pPJV7563 by Seamless cloning. The open reading frame nucleotide sequence of Plasmid 1318 is set forth in SEQ ID NO:45. The amino acid sequence encoded by Plasmid 1318 is set for in SEQ ID NO:46.

Plasmid 1319 (cMSLN-EMC2A-Muc1-ERB2A-Tert240).

Plasmid 1319 was constructed using the techniques of PCR and Seamless cloning. First, the genes encoding human mesothelin precursor amino acids 37-597, an EMCV 2A peptide, and the amino terminal half of human Mucin-1 were amplified by PCR from plasmid 1316 with primers f pmed Nhe cMSLN and r muc 986-963. The genes encoding the carboxy terminal half of Mucin-1, an ERBV 2A peptide, and human telomerase amino acids 241-1132 were amplified by PCR from plasmid 1270 with primers f Muc 960-983 and r pmed Bgl Ter240. The partially overlapping amplicons were digested with Dpn I, mixed together, and cloned into the Nhe I/Bgl II sites of pPJV7563 by Seamless cloning. The open reading frame nucleotide sequence of Plasmid 1319 is set forth in SEQ ID NO:47. The amino acid sequence encoded by Plasmid 1319 is set for in SEQ ID NO:48.

Plasmid 1320 (cMSLN-T2A-Tert240-ERB2A-Muc1).

Plasmid 1320 was constructed using the techniques of PCR and Seamless cloning. First, the genes encoding human mesothelin precursor amino acids 37-597, a TAV 2A peptide, and the amino terminal half of human telomerase were amplified by PCR from plasmid 1274 with primers f pmed Nhe cMSLN and r tert 1602-1579. The genes encoding the carboxy terminal half of telomerase, an ERBV 2A peptide, and human Mucin-1 amino acids 2-225, 946-1255 were amplified by PCR from plasmid 1271 with primers f tert 1584-1607 and r pmed Bgl Muc. The partially overlapping amplicons were digested with Dpn I, mixed together, and cloned into the Nhe I/Bgl II sites of pPJV7563 by Seamless cloning. The open reading frame nucleotide sequence of Plasmid 1320 is set forth in SEQ ID NO:49. The amino acid sequence encoded by Plasmid 1320 is set for in SEQ ID NO:50.

Plasmid 1321 (Tert240-T2A-cMSLN-EMC2A-Muc1).

Plasmid 1321 was constructed using the techniques of PCR and Seamless cloning. First, the gene encoding the amino terminal half of human telomerase was amplified by PCR from plasmid 1112 with primers f pmed Nhe Ter240 and r tert 1602-1579. The genes encoding the carboxy terminal half of telomerase, a TAV 2A peptide, and the amino terminal half of human mesothelin precursor were amplified by PCR from plasmid 1272 with primers f tert 1584-1607 and r MSLN 1051-1033. The genes encoding the carboxy terminal half of human mesothelin precursor, an EMCV 2A peptide, and human Mucin-1 amino acids 2-225, 946-1255 were amplified by PCR from plasmid 1316 with primers f MSLN 1028-1051 and r pmed Bgl Muc. The three partially overlapping amplicons were mixed together and cloned into the Nhe I/Bgl II sites of pPJV7563 by Seamless cloning. The open reading frame nucleotide sequence of Plasmid 1321 is set forth in SEQ ID NO:51. The amino acid sequence encoded by Plasmid 1321 is set for in SEQ ID NO:52.

Plasmid 1322 (Tert240-ERB2A-Muc1-EMC2A-cMSLN).

Plasmid 1322 was constructed using the techniques of PCR and Seamless cloning. First, the genes encoding human telomerase amino acids 241-1132, an ERBV 2A peptide, and the amino terminal half of human Mucin-1 were amplified by PCR from plasmid 1271 with primers f pmed Nhe Ter240 and r muc 986-963. The genes encoding the carboxy terminal half of Mucin-1, an EMCV 2A peptide, and human mesothelin precursor amino acids 37-597 were amplified by PCR from plasmid 1313 with primers f Muc 960-983 and r pmed Bgl cMSLN. The partially overlapping amplicons were digested with Dpn I, mixed together, and cloned into the Nhe I/Bgl II sites of pPJV7563 by Seamless cloning. The open reading frame nucleotide sequence of Plasmid 1322 is set forth in SEQ ID NO:53. The amino acid sequence encoded by Plasmid 1322 is set for in SEQ ID NO:54.

Plasmid 1351 (Muc1-EMC2A-cMSLN-T2A-Tert541).

Plasmid 1351 was constructed using the techniques of PCR and Seamless cloning. First, the genes encoding human Mucin-1 amino acids 2-225, 946-1255, an EMCV 2A peptide, and the human mesothelin precursor were amplified by PCR from plasmid 1313 with primers f pmed Nhe Muc and r T2A Bamh cMSLN. The genes encoding a TAV 2A peptide and human telomerase amino acids 541-1132 were amplified by PCR from plasmid 1330 with primers f1 T2A Tert d541, f2 T2A, and r pmed Bgl Ter240. The partially overlapping amplicons were digested with Dpn I, mixed together, and cloned into the Nhe I/Bgl II sites of pPJV7563 by Seamless cloning. The open reading frame nucleotide sequence of Plasmid 1351 is set forth in SEQ ID NO:55. The amino acid sequence encoded by Plasmid 1351 is set for in SEQ ID NO:56.

Plasmid 1352 (cMSLN-EMC2A-Muc1-ERB2A-Tert541).

Plasmid 1352 was constructed using the techniques of PCR and Seamless cloning. First, the genes encoding human mesothelin precursor amino acids 37-597, an EMCV 2A peptide, and human Mucin-1 were amplified by PCR from plasmid 1316 with primers f pmed Nhe cMSLN and r ERB2A Bamh Muc. The genes encoding an ERBV 2A peptide and human telomerase amino acids 541-1132 were amplified by PCR from plasmid 1330 with primers f1 ERBV2A Tert d541, f2 ERBV2A, and r pmed Bgl Ter240. The partially overlapping amplicons were digested with Dpn I, mixed together, and cloned into the Nhe I/Bgl II sites of pPJV7563 by Seamless cloning. The open reading frame nucleotide sequence of Plasmid 1352 is set forth in SEQ ID NO:57. The amino acid sequence encoded by Plasmid 1352 is set for in SEQ ID NO:58.

Plasmid 1353 (cMSLN-T2A-Tert541-ERB2A-Muc1).

Plasmid 1353 was constructed using the techniques of PCR and Seamless cloning. First, the gene encoding human mesothelin precursor amino acids 37-597 was amplified by PCR from plasmid 1103 with primers f pmed Nhe cMSLN, r2 T2A, and r T2A Bamh cMSLN. The genes encoding a TAV 2A peptide, human telomerase amino acids 541-1132, an ERBV 2A peptide, and human Mucin-1 amino acids 2-225, 946-1255 were amplified by PCR from plasmid 1271 with primers f1 T2A Tert d541 and r pmed Bgl Muc. The partially overlapping amplicons were digested with Dpn I, mixed together, and cloned into the Nhe I/Bgl II sites of pPJV7563 by Seamless cloning. The open reading frame nucleotide sequence of Plasmid 1353 is set forth in SEQ ID NO:59. The amino acid sequence encoded by Plasmid 1353 is set for in SEQ ID NO:60.

Plasmid 1354 (Muc1-EMC2A-cMSLN-T2A-Tert342).

Plasmid 1354 was constructed using the techniques of PCR and Seamless cloning. First, the genes encoding human Mucin-1 amino acids 2-225, 946-1255, an EMCV 2A peptide, and the human mesothelin precursor were amplified by PCR from plasmid 1313 with primers f pmed Nhe Muc and r T2A Bamh cMSLN. The genes encoding a TAV 2A peptide and human telomerase amino acids 342-1132 were amplified by PCR from plasmid 1326 with primers f1 T2A Tert d342, f2 T2A, and r pmed Bgl Ter240. The partially overlapping amplicons were digested with Dpn I, mixed together, and cloned into the Nhe I/Bgl II sites of pPJV7563 by Seamless cloning. The open reading frame nucleotide sequence of Plasmid 1354 is set forth in SEQ ID NO:61. The amino acid sequence encoded by Plasmid 1354 is set for in SEQ ID NO:62.

Plasmid 1355 (cMSLN-EMC2A-Muc1-ERB2A-Tert342).

Plasmid 1355 was constructed using the techniques of PCR and Seamless cloning. First, the genes encoding human mesothelin precursor amino acids 37-597, an EMCV 2A peptide, and human Mucin-1 were amplified by PCR from plasmid 1316 with primers f pmed Nhe cMSLN and r ERB2A Bamh Muc. The genes encoding an ERBV 2A peptide, and human telomerase amino acids 342-1132 were amplified by PCR from plasmid 1326 with primers f1 ERBV2A Ter d342, f2 ERBV2A, and r pmed Bgl Ter240. The partially overlapping amplicons were digested with Dpn I, mixed together, and cloned into the Nhe I/Bgl II sites of pPJV7563 by Seamless cloning. The open reading frame nucleotide sequence of Plasmid 1355 is set forth in SEQ ID NO:63. The amino acid sequence encoded by Plasmid 1355 is set for in SEQ ID NO:64.

Plasmid 1356 (cMSLN-T2A-Tert342-ERB2A-Muc1).

Plasmid 1356 was constructed using the techniques of PCR and Seamless cloning. First, the gene encoding human mesothelin precursor amino acids 37-597 was amplified by PCR from plasmid 1103 with primers f pmed Nhe cMSLN, r2 T2A, and r T2A Bamh cMSLN. The genes encoding a TAV 2A peptide, human telomerase amino acids 342-1132, an ERBV 2A peptide, and human Mucin-1 amino acids 2-225, 946-1255 were amplified by PCR from plasmid 1271 with primers f1 T2A Tert d342 and r pmed Bgl Muc. The partially overlapping amplicons were digested with Dpn I, mixed together, and cloned into the Nhe I/Bgl II sites of pPJV7563 by Seamless cloning. The resulting clone #3 contained an unintended single base mutation. To correct the mutation, PCR and Seamless cloning were repeated using clone #3 as the template. The genes encoding human mesothelin precursor amino acids 37-597, a TAV 2A peptide, and the amino terminal half of human telomerase were amplified by PCR from clone #3 with primers f pmed Nhe cMSLN and r tert 1602-1579. The genes encoding the carboxy terminal half of telomerase, an ERBV 2A peptide, and human Mucin-1 amino acids 2-225, 946-1255 were amplified by PCR from clone #3 with primers f tert 1584-1607 and r pmed Bgl Muc. The partially overlapping amplicons were digested with Dpn I, mixed together, and cloned into the Nhe I/Bgl II sites of pPJV7563 by Seamless cloning. The open reading frame nucleotide sequence of Plasmid 1356 is set forth in SEQ ID NO:65. The amino acid sequence encoded by Plasmid 1356 is set for in SEQ ID NO:66.

1D. Vector Construction

Vectors for expressing single or multi-antigen constructs were constructed from chimpanzee adenovirus Ad68 genomic sequences. Three versions of the AdC68 backbone without transgenes (called "empty vectors") were designed in silico. The vectors differed only in the extent of the E1 and E3 deletions that were engineered into the viruses to render them replication incompetent and create space for transgene insertion. Vectors AdC68W and AdC68X were described in international patent application WO2015/063647A1. Vector AdC68Y, carrying deletions of bases 456-3256 and 27476-31831, was engineered to have improved growth properties over AdC68X and a greater transgene carrying capacity than AdC68W. All three empty vectors were biochemically synthesized in a multi-stage process utilizing in vitro oligo synthesis and subsequent recombination-mediated intermediate assembly in *Escherichia coli* (*E. coli*) and yeast. Open reading frames (ORF) encoding the various immunogenic TAA polypeptides were amplified by PCR from the plasmids described in the Examples. Open reading frames were then inserted into the empty vector bacmids. Recombinant viral genomes were released from the bacmids by digestion with PacI and the linearized nucleic acids were transfected into an E1 complimenting adherent HEK293 cell line. Upon visible cytopathic effects and adenovirus foci formation, cultures were harvested by multiple rounds of freezing/thawing to release virus from the cells. Viruses were amplified and purified by standard techniques.

Example 2. Immunogenicity of Immunogenic Muc1 Single-Antigen Constructs

Study in HLA-A2/DR1 Mice

Study design.

Twelve mixed gender HLA-A2/DR1 mice were primed on day 0 and boosted on day 14 with DNA construct Plasmid 1027 (which encodes the membrane-bound immunogenic MUC1 polypeptide of SEQ ID NO:8) or Plasmid 1197 (which encodes the cytosolic immunogenicMUC1 polypeptide of SEQ ID NO:16) using the PMED method. On day 21, mice were sacrificed and splenocytes assessed for MUC1-specific cellular immunogenicity in an interferon-gamma (IFN-γ) ELISpot and intracellular cytokine staining (ICS) assay.

Particle Mediated Epidermal Delivery (PMED).

PMED is a needle-free method of administering DNAs to a subject. The PMED system involves the precipitation of DNA onto microscopic gold particles that are then propelled by helium gas into the epidermis. The ND10, a single use device, uses pressurized helium from an internal cylinder to deliver gold particles and the X15, a repeater delivery device, uses an external helium tank which is connected to the X15 via high pressure hose to deliver the gold particles. Both of these devices were used in studies to deliver the MUC1 DNA plasmids. The gold particle was usually 1-3 μm in diameter and the particles were formulated to contain 2 μg of antigen DNA plasmids per 1 mg of gold particles. (Sharpe, M. et al.: P. Protection of mice from H5N1 influenza challenge by prophylactic DNA vaccination using particle mediated epidermal delivery. Vaccine, 2007, 25(34): 6392-98: Roberts L K, et al.: Clinical safety and efficacy of a powdered Hepatitis B nucleic acid vaccine delivered to the epidermis by a commercial prototype device. Vaccine, 2005; 23(40):4867-78).

IFN-γ ELISpot Assay.

Splenocytes from individual animals were co-incubated in triplicate with individual Ag-specific peptides (each peptide at 2-10 ug/ml, 2.5-5e5 cells per well) or pools of 15mer Ag-specific peptides (overlapping by 11 amino acids, covering the entire Ag-specific amino acid sequence; each peptide at 2-5 ug/ml, 1.25-5e5 cells per well) in IFN-γ ELISPOT plates (see also Peptide Pools Table (Table 18), and Tables 15-17). The plates were incubated for ~16 hours at 37° C., 5% $CO_2$, then washed and developed, as per manufacturer's instruction. The number of IFN-γ spot forming cells (SFC) was counted with a CTL reader. The average of the triplicates was calculated and the response of the negative control wells, which contained no peptides, subtracted. The SFC counts were then normalized to describe the response per 1e6 splenocytes. The antigen-specific responses in the tables represent the sum of the responses to the Ag-specific peptides or peptide pools.

Ics Assay.

Splenocytes from individual animals were co-incubated with H-2b-, HLA-A2-, or HLA-A24-restricted Ag-specific peptides (each peptide at 5-10 ug/ml, 1-2e6 splenocytes per well) or pools of 15mer Ag-specific peptides (overlapping by 11 amino acids, covering the entire Ag-specific amino acid sequence; each peptide at 2-5 ug/ml, 1-2e6 splenocytes per well) in U-bottom 96-well-plate tissue culture plates (see also Peptide Pools Table (Table 18) and Tables 15-17). The plates were incubated ~16 hours at 37° C., 5% $CO_2$. The cells were then stained to detect intracellular IFN-γ expression from $CD8^+$ T cells and fixed. Cells were acquired on a flow cytometer. The data was presented per animal as frequency of peptide(s) Ag- or peptide pool Ag-specific IFN-γ$^+$ $CD8^+$ T cells after subtraction of the responses obtained in the negative control wells, which contained no peptide.

Sandwich ELISA Assay.

The standard sandwich ELISA assay was done using the Tecan Evo, Biomek Fx$^P$, and BioTek 405 Select TS automation instruments. The 384 well microplates (flat-well, high binding) were coated at 25 μl/well with 1.0 μg/mL human MUC1 or human MSLN protein (antigen) in 1×PBS, and incubated overnight at 4° C.

The next morning, plates were blocked for one hour at RT with 5% FBS in PBS with 0.05% Tween 20 (PBS-T). Mouse sera was prepared at a 1/100 starting dilution in PBS-T in 96 U-bottom well plates. The Tecan Evo performed ½ log serial dilutions in PBS-T over 9 dilution increment points, followed by stamping of 25 μl/well of diluted serum from the 96 well plates to 384 well plates. The 384 well plates were incubated for 1 hour at RT on a shaker at 600 RPM, then, using the BioTek EL 405 Select TS plate washer, the plates were washed 4 times in PBS-T. Secondary mouse anti-IgG-HRP antibody was diluted to an appropriate dilution and stamped by Biomek Fx$^P$ at 25 μl/well into 384 well plates, and incubated for 1 hour at RT on a shaker at 600 RPM, followed by 5 repeated washes. Using the Biomek Fx$^P$, plates were stamped at 25 μl/well of RT TMB substrate and incubated in the dark at RT for 30 minutes, followed by 25 μl/well stamping of 1N $H_2SO_4$ acid to stop the enzymatic reaction. Plates were read on the Molecular Devices, Spectramax 340PC/384 Plus at 450 nm wavelength. Data were reported as calculated titers at OD of 1.0 with a limit of detection of 99.0. The antigen-specific commercial monoclonal antibody was used in each plate as a positive control to track plate-to-plate variation performance; irrelevant vaccinated mouse serum was used as a negative control, and PBS-T only wells were used to monitor non-specific binding background. Titers in the tables represent antigen-specific IgG titers elicited from individual animals.

Results.

Table 1 shows ELISpot and ICS data from HLA-A2/DR1 splenocytes cultured with peptide pools derived from the MUC1 peptide library (see also tables 15 and 18) or MUC1 peptide aa516-530, respectively. Numbers in column 3 represent # IFN-γ spots/10$^6$ splenocytes after restimulation with MUC1 peptide pools, and background subtraction. Numbers in column 4 represent the frequency of $CD8^+$ T cells being IFN-γ$^+$ after restimulation with MUC1 peptide aa516-530 and background subtraction. A positive response is defined as having SFC>100 and a frequency of IFN-γ$^+$ $CD8^+$ T cells >0.05%. As shown in Table 1, the immunogenic MUC1 polypeptides made with the full-length membrane-bound (Plasmid 1027) and cytosolic (Plasmid 1197) MUC1 constructs described in Example 1A above are capable of inducing MUC1-specific T cell responses including HLA-A2-restricted MUC1 peptide aa516-530-specific $CD8^+$ T cell responses. The cytosolic MUC1 antigen format induced the highest magnitude of T cell responses. Importantly, T cell responses derived from cancer patients against the MUC1 peptide aa516-530 have been shown to correlate with anti-tumor efficacy in vitro (Jochems C et al., Cancer Immunol Immunother (2014) 63:161-174) demonstrating the importance of raising cellular responses against this specific epitope.

TABLE 1

T cell response induced by the single-antigen MUC1 DNA constructs (Plasmid 1027 and Plasmid 1197) in HLA-A2/DR1 mice

| Construct ID | Animal # | # IFN-γ spots/10$^6$ splenocytes | % $CD8^+$ T cells being IFN-γ$^+$ |
|---|---|---|---|
| Plasmid 1027 | 31 | 494 | 2.25 |
|  | 32 | 277 | 1.44 |
|  | 33 | 475 | 0.10 |
|  | 34 | 1096 | 0.84 |
|  | 35 | 282 | 1.45 |
|  | 36 | 649 | 1.36 |
| Plasmid 1197 | 43 | 569 | 4.69 |
|  | 44 | 1131 | 2.15 |
|  | 45 | 122 | 2.81 |
|  | 46 | 373 | 1.73 |
|  | 47 | 503 | 1.80 |
|  | 48 | 2114 | 5.52 |

Study in HLA-A24 Mice

Study Design.

Mixed gender HLA-A24 mice were primed on day 0 and boosted on days 14, 28 and 42 with DNA construct Plasmid 1027 by PMED administration. On day 21, mice were sacrificed and splenocytes assessed for MUC1-specific cellular immunogenicity (ELISpot).

Results.

Table 2 shows ELISpot data from HLA-A24 splenocytes cultured with peptide pools derived from the MUC1 peptide library (see also Peptide Pools Table (Table 18) and Table 15). Numbers in column 3 represent # IFN-γ spots/10$^6$ splenocytes after restimulation with MUC1 peptide pools and background subtraction. The number in bold font indicates that at least 1 peptide pool tested was too numerous to count, therefore the true figure is at least the value stated. A positive response is defined as having SFC>100. As shown in Table 2, membrane-bound MUC1 construct is capable of inducing MUC1-specific cellular responses.

TABLE 2

T cell response induced by the single-antigen DNA construct Plasmid 1027 encoding human native full-length membrane-bound MUC1 antigen in HLA-A24 mice

| Construct ID | Animal # | # IFN-γ spots/10$^6$ splenocytes |
|---|---|---|
| Plasmid 1027 | 8 | 3341 |
|  | 9 | 3181 |
|  | 10 | 6207 |
|  | 11 | 3112 |
|  | 12 | 3346 |
|  | 13 | 3699 |

Study in Monkeys

Study Design.

14 Chinese cynomolgus macaques were primed with an AdC68W adenovirus vector encoding the cytosolic (Plasmid 1197) or full-length membrane-bound MUC1 antigen (Plasmid 1027) at 2e11 viral particles by bilateral intramuscular injection (1 mL total). 29 days later, animals were boosted with DNA encoding cytosolic or full-length membrane-bound MUC1 antigen delivered intramuscularly bilaterally via electroporation (2 mL total). Anti-CTLA-4 was administered subcutaneously on days 1 (32 mg) and 29 (50 mg).

14 days after the last immunization, animals were bled and PBMCs and sera isolated to assess MUC1-specific cellular (ELISpot, ICS) and humoral (ELISA) responses, respectively.

NHP-Specific Immune Assays.

EL/Spot assay. PBMCs from individual animals were co-incubated in duplicate with pools of 15mer Ag-specific peptides (overlapping by 11 amino acids, covering the entire Ag-specific amino acid sequence), each peptide at 2 ug/ml, 4e5 cells per well, in IFN-γ ELISPOT plates (see also Peptide Pools Table (Table 18) and Tables 15-17). The plates were incubated for ~16 hours at 37° C., 5% $CO_2$, then washed and developed, as per manufacturer's instruction. The number of IFN-γ spot forming cells (SFC) was counted with a CTL reader. The average of the duplicates was calculated and the response of the negative control wells, which contained no peptides, subtracted. The SFC counts were then normalized to describe the response per 1e6 PBMCs. The antigen-specific responses in the tables represent the sum of the responses to the Ag-specific peptide pools.

Ics Assay.

PBMCs from individual animals were co-incubated with pools of 15mer MUC1 peptides (overlapping by 11 amino acids, covering the entire native full-length MUC1 amino acid sequence; see Table 15), each peptide at 2 ug/mL, 1.5-2e6 PBMCs per well, in U-bottom 96-well-plate tissue culture plates. The plates were incubated for ~16 hours at 37° C., 5% $CO_2$, and then stained to detect intracellular IFN-γ expression from CD8 T cells. After fixation, the cells were acquired on a flow cytometer. The results are presented per individual animal as number of MUC1, MSLN, or TERT-specific IFN-γ$^+$ CD8$^+$ T cells after subtraction of the responses obtained in the negative control wells, which contained no peptide, and normalized to 1 e6 CD8$^+$ T cells.

Sandwich ELISA Assay.

The standard sandwich ELISA assay was done using the Tecan Evo, Biomek Fx$^P$, and BioTek 405 Select TS automation instruments. The 384 well microplates (flat-well, high binding) were coated at 25 μl/well with 1.0 μg/mL human MUC1 or human MSLN protein (antigen) in 1×PBS, and incubated overnight at 4° C. The next morning, plates were blocked for one hour at RT with 5% FBS in PBS with 0.05% Tween 20 (PBS-T). Sera from Chinese cynomolgus macaques was prepared at a 1/100 starting dilution in PBS-T in 96 U-bottom well plates. The Tecan Evo performed ½ log serial dilutions in PBS-T over 9 dilution increment points, followed by stamping of 25 μl/well of diluted serum from the 96 well plates to 384 well plates. The 384 well plates were incubated for 1 hour at RT on a shaker at 600 RPM, then, using the BioTek EL 405 Select TS plate washer, the plates were washed 4 times in PBS-T. Secondary rhesus anti-IgG-HRP antibody, which cross-reacts with cynomolgus IgG, was diluted to an appropriate dilution and stamped by Biomek Fx$^P$ at 25 μl/well into 384 well plates, and incubated for 1 hour at RT on a shaker at 600 RPM, followed by 5 repeated washes. Using the Biomek Fx$^P$, plates were stamped at 25 μl/well of RT TMB substrate and incubated in the dark at RT for 30 minutes, followed by 25 μl/well stamping of 1N $H_2SO_4$ acid to stop the enzymatic reaction. Plates were read on the Molecular Devices, Spectramax 340PC/384 Plus at 450 nm wavelength. Data were reported as calculated titers at OD of 1.0 with a limit of detection of 99.0. The antigen-specific commercial monoclonal antibody was used in each plate as a positive control to track plate-to-plate variation performance; irrelevant vaccinated mouse serum was used as a negative control, and PBS-T only wells were used to monitor non-specific binding background. Titers in the tables represent antigen-specific IgG titers elicited from individual animals.

Results.

Table 3 shows the ELISpot and ICS data from Chinese cynomolgus macaques' PBMCs cultured with peptide pools derived from the MUC1 peptide library (see also Peptide Pools Table (Table 18) and Table 15), and the ELISA data from Chinese cynomolgus macaques' sera. Numbers in column 3 represent # IFN-γ spots/10$^6$ PBMCs after restimulation with MUC1 peptide pools and background subtraction. Numbers in column 4 represent # IFN-γ$^+$ CD8$^+$ T cells/10$^6$ CD8$^+$ T cells after restimulation with MUC1 peptide pools and background subtraction. Numbers in column 5 represent the anti-MUC1 IgG titer (Optical Density (O.D)=1, Limit of Detection (L.O.D)=99.0). A positive response is defined as having SFC>50, IFN-γ$^+$ CD8$^+$ T cells/1e6 CD8$^+$ T cells >50, and IgG titers >99. As shown in Table 3, the immunogenic MUC1 polypeptides made with the cytosolic (1197) and native full-length membrane-bound (1027) MUC1 constructs are capable of inducing MUC1-specific T and B cell responses. The native full-length membrane-bound MUC1 construct (1027) was shown to induce the overall best MUC1-specific cellular and humoral response.

TABLE 3

T and B cell responses induced by the single-antigen adenoviral AdC68W and single-antigen DNA constructs (Plasmid 1197; Plasmid 1027) in Chinese cynomolgus macaques

| Construct ID # | Animal # | # IFN-γ spots/10$^6$ splenocytes | # IFN-γ$^+$ CD8$^+$ T cells/1e6 CD8$^+$ T cells | IgG titer |
|---|---|---|---|---|
| Plasmid 1197 | 4001 | 0 | 0.0 | 8589.7 |
| | 4002 | 38 | 1549.0 | 4245.9 |
| | 4003 | 17 | 0.0 | 2631.9 |
| | 4501 | 165 | 4792.3 | 614.6 |
| | 4502 | 1703 | 47727.4 | 1882.8 |
| | 4503 | 0 | 802.8 | 4366.4 |
| | 4504 | 373 | 1857.0 | 4419.3 |
| Plasmid 1027 | 5001 | 797 | 813.5 | 5332.2 |
| | 5002 | 1013 | 312.9 | 16233.5 |
| | 5003 | 1011 | 9496.9 | 6885.8 |
| | 5004 | 175 | 170.2 | 48759.0 |
| | 5501 | 214 | 4803.3 | 13010.4 |
| | 5502 | 306 | 8367.6 | 13115.3 |
| | 5503 | 405 | 0.0 | 89423.0 |

Example 3. Immunogenicity of Msln Single-Antigen Constructs

Immune Response Study in Pasteur (HLA-A2/DR1) Mice Study design.

Twelve female HLA-A2/DR1 mice were primed with an AdC68W adenovirus vector encoding the membrane-bound (Plasmid 1084) or cytosolic MSLN antigen (Plasmid 1103) at 1e10 viral particles by intramuscular injection (50 ul). 28 days later, animals were boosted with DNA single-antigen construct encoding an immunogenic MSLN polypeptide using PMED method as described in Example 2. The antigen-specific T cell response was measured seven days later in an IFN-γ ELISPOT and ICS assay.

Results.

Table 4 shows ELISpot and ICS data from HLA-A2/DR1 splenocytes cultured with peptide pools derived from the MSLN peptide library (see also Peptide Pools Table (Table 18) and Table 16) or MSLN peptides aa50-64, aa102-116, and aa542-556, respectively. Numbers in column 3 represent

IFN-γ spots/$10^6$ splenocytes after restimulation with MSLN peptide pools and background subtraction. Numbers in column 4 represent the frequency of CD8+ T cells being IFN-γ+ after restimulation with MSLN peptides aa50-64, aa102-116 and aa542-556, and background subtraction. A positive response is defined as having SFC>100 and a frequency of IFN-γ+ CD8+ T cells >0.05%. As shown in Table 4, the immunogenic MSLN polypeptides made with the membrane-bound (1084) and cytosolic (1103) MSLN constructs described in Example 1A above are capable of inducing MSLN-specific T cell responses. The cytosolic MSLN antigen format induced the highest magnitude of MSLN-specific T cell responses.

TABLE 4

T cell response induced by the single-antigen adenoviral AdC68W and single-antigen DNA constructs in HLA-A2/DR1 mice

| Construct ID | Animal # | # IFN-γ spots/$10^6$ splenocytes | % CD8+ T cells being IFN-γ+ |
|---|---|---|---|
| Plasmid 1084 | 37 | 1744 | 1.07 |
|  | 38 | 3488 | 3.13 |
|  | 39 | 1905 | 0.19 |
|  | 40 | 1649 | 2.47 |
|  | 41 | 1900 | 0.09 |
|  | 42 | 1108 | 1.87 |
| Plasmid 1103 | 49 | 4839 | 2.34 |
|  | 50 | 4685 | 13.49 |
|  | 51 | 2508 | 3.69 |
|  | 52 | 1865 | 2.09 |
|  | 53 | 708 | 0.38 |
|  | 54 | 2525 | 4.41 |

Immune Response Study in HLA A24 Mice

Study Designs.

Twelve mixed-gender HLA-A24 mice were immunized with membrane-bound (1084) or cytosolic MSLN (1103) DNA constructs using the PMED method in a prime/boost/boost/boost regimen, two weeks apart between each vaccination. MSLN-specific T cell responses were measured 7 days after the last immunization in an IFN-γ ELISpot and ICS assay.

Results.

Table 5 shows ELISpot and ICS data from HLA-A24 splenocytes cultured with peptide pools derived from the MSLN peptide library (see also Peptide Pools Table (Table 18) and Table 16) or MSLN peptides aa130-144 and aa230-244, respectively. Numbers in column 3 represent # IFN-γ spots/$10^6$ splenocytes after restimulation with MSLN peptide pools and background subtraction. Numbers in column 4 represent the frequency of CD8+ T cells being IFN-γ+ after restimulation with MSLN peptides aa130-144 and aa230-244, and background subtraction. A positive response is defined as having SFC>100 and a frequency of IFN-γ+ CD8+ T cells >0.05%. As shown in Table 5, the immunogenic MSLN polypeptides made with the membrane-bound (1084) and cytosolic MSLN (1103) constructs are capable of inducing MSLN-specific T cell responses. The cytosolic MSLN antigen format induced the highest magnitude of MSLN-specific T cell responses.

TABLE 5

T cell response induced by the single-antigen DNA constructs in HLA-A24 mice

| Construct ID | Animal # | # IFN-γ spots/$10^6$ splenocytes | % CD8+ T cells being IFN-γ+ |
|---|---|---|---|
| Plasmid 1084 | 1 | 47 | Not determined |
|  | 2 | 161 | Not determined |
|  | 3 | 13 | Not determined |
|  | 7 | 105 | Not determined |
|  | 8 | 232 | Not determined |
|  | 9 | 151 | Not determined |
| Plasmid 1103 | 13 | 2440 | 0.00 |
|  | 14 | 2345 | 0.17 |
|  | 15 | 1789 | 0.00 |
|  | 19 | 3184 | 0.64 |
|  | 21 | 5463 | 1.62 |
|  | 22 | 2324 | 0.39 |

Immune Response Study in Monkeys

Study Design.

14 Chinese cynomolgus macaques were primed with an AdC68W adenovirus vector encoding the membrane-bound (Plasmid 1084) or cytosolic MSLN antigen (Plasmid 1103) at 2e11 viral particles by bilateral intramuscular injection (1 mL total). 29 days later, animals were boosted with DNA encoding membrane-bound (1084) or cytosolic MSLN antigen (1103) delivered intramuscularly bilaterally via electroporation (2 mL total). Anti-CTLA-4 was administered subcutaneously on days 1 (32 mg) and 29 (50 mg). 14 days after the last immunization, animals were bled and PBMCs and serum isolated to assess MSLN-specific cellular (ELISpot, ICS) and humoral (ELISA) responses, respectively.

Results.

Table 6 shows the ELISpot and ICS data from Chinese cynomolgus macaques' PBMCs cultured with peptide pools derived from the MSLN peptide library (see also Peptide Pools Table (Table 18) and Table 16), and the ELISA data from Chinese cynomolgus macaques' sera. Numbers in column 3 represent # IFN-γ spots/$10^6$ splenocytes after restimulation with MSLN peptide pools and background subtraction. Numbers in column 4 represent # IFN-γ+ CD8+ T cells/$10^6$ CD8+ T cells after restimulation with MSLN peptide pools and background subtraction. Numbers in column 5 represent the anti-MSLN IgG titer (Optical Density (O.D)=1, Limit of Detection (L.O.D)=99.0). A positive response is defined as having SFC>50, IFN-γ+ CD8+ T cells/1e6 CD8+ T cells >50, and IgG titers >99. As shown in Table 6, the immunogenic MSLN polypeptides made with the membrane-bound (1084) and cytosolic (1103) MSLN constructs are capable of inducing MSLN-specific T and B cell responses. The cytoplasmic MSLN construct (Plasmid 1103) was shown to induce the strongest MSLN-specific cellular response; in contrast, the membrane-bound MSLN construct (Plasmid 1084) was shown to induce the strongest MSLN-specific humoral response.

TABLE 6

T and B cell responses induced by the single-antigen adenoviral AdC68W and single-antigen DNA constructs in Chinese cynomolgus macaques

| Construct ID # | Animal # | # IFN-γ spots/10⁶ splenocytes | # IFN-γ⁺ CD8⁺ T cells/ 1e6 CD8⁺ T cells | IgG titer |
|---|---|---|---|---|
| Plasmid 1084 | 1001 | 390 | 181.4 | 40886.6 |
|  | 1002 | 787 | 512.0 | 41476.1 |
|  | 1003 | 2083 | 5642.6 | 11948.1 |
|  | 1501 | 894 | 1083.7 | 41248.3 |
|  | 1502 | 1789 | 6501.0 | 42668.3 |
|  | 1503 | 2358 | 37238.3 | 42026.5 |
|  | 1504 | 269 | 1340.9 | 43023.6 |
| Plasmid 1103 | 2001 | 2131 | 15318.5 | 1459.3 |
|  | 2002 | 2818 | 7163.4 | 99.0 |
|  | 2003 | 1115 | 2291.0 | 2393.2 |
|  | 2004 | 948 | 3602.6 | 1948.0 |
|  | 2501 | 2477 | 13741.4 | 1751.7 |
|  | 2502 | 2082 | 9318.7 | 15412.5 |
|  | 2503 | 831 | 1797.8 | 99.0 |

Example 4. Immunogenicity of Tert Single-Antigen Constructs

Immune Responses Study in Pasteur Mice
Study Design.

Six mixed gender HLA-A2/DR1 mice were primed with an AdC68W adenovirus vector encoding the truncated (Δ240) cytosolic immunogenic TERT polypeptide (Plasmid 1112) at 1e10 viral particles by intramuscular injection (50 ul). 28 days later, animals were boosted intramuscularly with 50 ug DNA delivered bilaterally via electroporation (2×20 ul) encoding the truncated (Δ240) cytosolic TERT antigen (Plasmid 1112). The antigen-specific T cell response was measured seven days later in an IFN-γ ELISPOT and ICS assay.

Results.

Table 7 shows ELISpot and ICS data from HLA-A2/DR1 splenocytes cultured with peptide pools derived from the TERT peptide library (see also Peptide Pools Table (Table 18) and Table 17) or TERT peptide aa861-875, respectively. Numbers in column 3 represent # IFN-γ spots/10⁶ splenocytes after restimulation with TERT peptide pools and background subtraction. Numbers in column 4 represent the frequency of CD8⁺ T cells being IFN-γ⁺ after restimulation with TERT peptide aa861-875 and background subtraction. A positive response is defined as having SFC>100 and a frequency of IFN-γ⁺ CD8⁺ T cells >0.05%. As shown in Table 7, the immunogenic TERT polypeptide made with the truncated (Δ240) cytosolic TERT construct described in Example 1A above is capable of inducing HLA-A2-restricted TERT-specific CD8 T cell responses.

TABLE 7

T cell response induced by the single-antigen adenoviral AdC68W and single-antigen DNA constructs (Plasmid 1112) encoding human truncated (Δ240) cytosolic TERT antigen in HLA-A2/DR1 mice

| Construct ID | Animal # | # IFN-γ spots/10⁶ splenocytes | % CD8⁺ T cells being IFN-γ⁺ |
|---|---|---|---|
| Plasmid 1112 | 13 | 2851 | 32.79 |
|  | 14 | 2691 | 13.60 |
|  | 15 | 3697 | 7.87 |
|  | 16 | 2984 | 21.30 |
|  | 17 | 1832 | 26.40 |
|  | 18 | 1385 | 3.16 |

Immune Responses Study in HLA A24 Mice
Study Designs.

Eight mixed gender HLA-A24 mice were primed with an AdC68W adenovirus vector encoding the truncated (Δ240) cytosolic TERT antigen (Plasmid 1112) at 1e10 viral particles total by bilateral intramuscular injection (50 ul into each tibialis anterior muscle). 14 days later, animals were boosted intramuscularly with 50 ug DNA delivered bilaterally via electroporation (2×20 ul) encoding the truncated (Δ240) cytosolic TERT antigen (Plasmid 1112). The antigen-specific T cell response was measured seven days later in an IFN-γ ELISPOT and ICS assay.

Results.

Table 8 shows IFN-γ ELISpot and ICS data from HLA-A24 splenocytes cultured with peptide pools derived from the TERT peptide library (see also Peptide Pools Table (Table 18) and Table 17) or TERT peptide aa841-855), respectively. Numbers in column 3 represent # IFN-γ spots/10⁶ splenocytes after restimulation with TERT peptide pools and background subtraction. Numbers in column 4 represent the frequency of CD8⁺ T cells being IFN-γ⁺ after restimulation with TERT peptides aa841-855, and background subtraction. The number in bold font indicates that at least 1 peptide pool tested was too numerous to count, therefore the true figure is at least the value stated. A positive response is defined as having SFC>100 and a frequency of IFN-γ⁺ CD8⁺ T cells >0.1%. As shown in Table 8, the immunogenic TERT polypeptide made with the truncated (Δ240) cytosolic TERT (1112) construct is capable of inducing HLA-A24-restricted TERT-specific CD8⁺ T cell responses.

TABLE 8

T cell response induced by the single-antigen adenoviral AdC68W single-antigen DNA constructs (Plasmid 1112) encoding human truncated (Δ240) cytosolic TERT antigen in HLA-A24 mice

| Construct ID | Animal # | # IFN-γ spots/10⁶ splenocytes | % CD8⁺ T cells being IFN-γ⁺ |
|---|---|---|---|
| Plasmid 1112 | 17 | 4233 | 41.5 |
|  | 18 | 2643 | 3.34 |
|  | 19 | 1741 | 31.5 |
|  | 20 | 3407 | 3.05 |
|  | 21 | 3213 | 0.0903 |
|  | 22 | 596 | 0 |
|  | 23 | 1875 | 13.8 |
|  | 24 | 2011 | 19.8 |

Immune Responses Study in Monkeys
Study Design.

Eight Chinese cynomolgus macaques were primed with an AdC68W adenovirus vector encoding the truncated (Δ240) cytosolic TERT antigen (Plasmid 1112) at 2e11 viral particles by bilateral intramuscular injection (1 mL total). 30 and 64 days later, animals were boosted with DNA (Plasmid 1112) encoding truncated (Δ240) cytosolic TERT antigen delivered intramuscularly bilaterally via electroporation (2 mL total). Anti-CTLA-4 was administered subcutaneously on days 1 (32 mg), 31 (50 mg) and 65 (75 mg). 14 days after the last immunization, animals were bled and PBMCs isolated to assess TERT-specific cellular (ELISpot, ICS) responses.

Results.

Table 9 shows the ELISpot and ICS data from Chinese cynomolgus macaques' PBMCs cultured with peptide pools derived from the TERT peptide library (see also Peptide Pools Table (table 18) and Table 17). Numbers in column 3 represent # IFN-γ spots/$10^6$ splenocytes after restimulation with TERT peptide pools and background subtraction. Numbers in column 4 represent # IFN-γ$^+$ CD8$^+$ T cells/$10^6$ CD8$^+$ T cells after restimulation with TERT peptide pools and background subtraction. A positive response is defined as having SFC>50 and IFN-γ$^+$ CD8$^+$ T cells/1e6 CD8$^+$ T cells >50. As shown in Table 9, the immunogenic TERT polypeptide made with the truncated (Δ240) cytosolic (Plasmid 1112) TERT construct is capable of inducing TERT-specific T cell responses.

TABLE 9

T cell response induced by the TERT single-antigen adenoviral AdC68W and TERT single-antigen DNA constructs in Chinese cynomolgus macaques

| Construct ID # | Animal # | # IFN-γ spots/$10^6$ splenocytes | # IFN-γ$^+$ CD8$^+$ T cells/1e6 CD8$^+$ T cells |
|---|---|---|---|
| Plasmid 1112 | 1001 | 3487 | 29472.2 |
| | 1002 | 1130 | 4906.6 |
| | 1003 | 2077 | 2984.2 |
| | 1004 | 133 | 337.8 |
| | 1501 | 3157 | 5325.1 |
| | 1502 | 2037 | 653.2 |
| | 1503 | 2697 | 16953.4 |
| | 1504 | 1208 | 1178.9 |

Example 5. Immunogenicity of Dual-Antigen Constructs

Immune Response Study in Monkeys

Study Design.

24 Chinese cynomolgus macaques were primed with dual-antigen adenoviral AdC68W vectors encoding human native full-length membrane-bound MUC1 (MUC1) and human truncated (Δ240) cytosolic TERT (TERT$_{Δ240}$) antigens at 2e11 viral particles by bilateral intramuscular injection (1 mL total). 30 and 64 days later, animals were boosted with dual-antigen DNA constructs (Plasmids 1270, 1271, and 1269) encoding the same two antigens delivered intramuscularly bilaterally via electroporation (2 mL total). Anti-CTLA-4 was administered subcutaneously on days 1 (32 mg), 31 (50 mg) and 65 (75 mg). 14 days after the last immunization, animals were bled and PBMCs and serum isolated to assess MUC1- and TERT-specific cellular (ELISpot, ICS) and MUC1-specific humoral (ELISA) responses, respectively. In total, three different dual-antigen constructs, which co-expressed both antigens, were evaluated: a) MUC1-2A-TERT$_{Δ240}$ (Plasmid 1270), an AdC68W vector and DNA plasmid encoding MUC1 and TERT linked by a 2A peptide; b) TERT$_{Δ240}$-2A-MUC1 (Plasmid 1271), an AdC68W vector and DNA plasmid encoding TERT and MUC1 linked by a 2A peptide; c) MUC1-TERT$_{Δ240}$ (Plasmid 1269), an AdC68W vector and DNA plasmid encoding the MUC1-TERT fusion protein (see also Example 1B).

Results.

Table 10 shows the ELISpot and ICS data from Chinese cynomolgus macaques' PBMCs cultured with peptide pools derived from the MUC1 and TERT peptide libraries (see also Peptide Pools Table (Table 18) and Tables 15 and 17), and the ELISA data from Chinese cynomolgus macaques' sera. A positive response is defined as having SFC>50, IFN-γ$^+$ CD8$^+$ T cells/1e6 CD8$^+$ T cells >50, and IgG titers >99. Numbers in columns 3 and 6 represent # IFN-γ spots/$10^6$ splenocytes after restimulation with MUC1 and TERT peptide pools and background subtraction, respectively. Numbers in bold font indicates that at least 1 peptide pool tested was too numerous to count, therefore the true figure is at least the value stated. Numbers in columns 4 and 7 represent # IFN-γ$^+$ CD8$^+$ T cells/$10^6$ CD8$^+$ T cells after restimulation with MUC1 peptide pools and TERT peptide pools, respectively, and background subtraction. Numbers in column 5 represent the anti-MUC1 IgG titer (Optical Density (O.D)=1, Limit of Detection (L.O.D)=99.0). As shown in Table 10, the immunogenic MUC1 and TERT polypeptides made with the MUC1- and TERT-expressing dual-antigen constructs (Plasmids 1270, 1271, and 1269) are capable of inducing MUC1- and TERT-specific T cell responses, and MUC1-specific B cell responses. The dual-antigen construct 1269 encoding a MUC1-TERT fusion protein was shown to induce the strongest overall MUC1-specific cellular response; in contrast, dual-antigen construct Plasmid 1271 (TERT-2A-MUC1) was shown to induce the strongest overall TERT-specific cellular response. All three dual-antigen constructs were shown to induce a comparable MUC1-specific humoral response.

TABLE 10

T and B cell responses induced by the dual-antigen adenoviral AdC68W and single-antigen DNA constructs (Plasmid 1270, 1271, and 1269) encoding an immunogenic MUC1 and/or TERT polypeptide in Chinese cynomolgus macaques

| Construct ID | Animal # | MUC1 | | | TERT | |
|---|---|---|---|---|---|---|
| | | # IFN-γ spots/$10^6$ splenocytes | # IFN-γ$^+$ CD8$^+$ T cells/1e6 CD8$^+$ T cells | IgG titer | # IFN-γ spots/$10^6$ splenocytes | # IFN-γ$^+$ CD8$^+$ T cells/1e6 CD8$^+$ T cells |
| Plasmid 1270 | 5001 | 813 | 1024.4 | 10725.8 | 307 | 436.9 |
| | 5002 | 2778 | 14740.6 | 27090.7 | 1573 | 423.0 |
| | 5003 | 217 | 1198.7 | 19339.6 | 1687 | 40680.3 |
| | 5004 | 298 | Excluded | 3980.3 | 252 | 805.3 |
| | 5501 | 2287 | 6255.7 | 16278.9 | 692 | 0.0 |
| | 5502 | 760 | 0.0 | 6496.2 | 3010 | 13302.0 |

TABLE 10-continued

T and B cell responses induced by the dual-antigen adenoviral AdC68W and single-antigen DNA constructs (Plasmid 1270, 1271, and 1269) encoding an immunogenic MUC1 and/or TERT polypeptide in Chinese cynomolgus macaques

| Construct ID | Animal # | MUC1 | | | TERT | |
|---|---|---|---|---|---|---|
| | | # IFN-γ spots/$10^6$ splenocytes | # IFN-γ$^+$ CD8$^+$ T cells/1e6 CD8$^+$ T cells | IgG titer | # IFN-γ spots/$10^6$ splenocytes | # IFN-γ$^+$ CD8$^+$ T cells/1e6 CD8$^+$ T cells |
| | 5503 | 1315 | 199.8 | 6446.4 | 3702 | 7259.3 |
| | 5504 | 500 | 281.8 | 39868.0 | 2005 | 13727.8 |
| Plasmid 1271 | 6001 | 1037 | 0.0 | 11770.3 | 2937 | 63106.1 |
| | 6002 | 185 | 0.0 | 13925.4 | 1295 | 194.8 |
| | 6003 | 372 | 267.4 | 15439.7 | 2138 | 46023.2 |
| | 6004 | 203 | 97.1 | 10530.7 | 1562 | 8424.0 |
| | 6501 | 1315 | 2137.3 | 43487.3 | 3794 | 20358.2 |
| | 6502 | 1008 | 179.2 | 8742.0 | 2955 | 1503.5 |
| | 6503 | 552 | 226.4 | 35183.4 | 1797 | 50008.6 |
| | 6504 | 2200 | 162.8 | 35539.9 | 4402 | 24058.6 |
| Plasmid 1269 | 7001 | 193 | 0.0 | 14868.3 | 3320 | 7321.5 |
| | 7002 | 1353 | 2153.2 | 7546.6 | 870 | 736.2 |
| | 7003 | 1253 | 133.5 | 21277.4 | 2750 | 25827.7 |
| | 7004 | 1858 | 20846.7 | 10359.9 | 3230 | 19664.0 |
| | 7501 | 2138 | 773.6 | 31272.8 | 927 | 332.0 |
| | 7502 | 2177 | 10547.7 | 16635.5 | 2640 | 7527.3 |
| | 7503 | 1460 | 5086.2 | 5465.1 | 2362 | 938.6 |
| | 7504 | 922 | 0.0 | 38530.4 | 2875 | 2949.3 |

Example 6. Immunogenicity of Triple-Antigen Constructs

Example 6 illustrates the capability of triple-antigen adenoviral and nucleic acid constructs expressing the human native full-length membrane-bound MUC1 antigen (MUC1), human cytosolic MSLN antigen (cMSLN), and human truncated (Δ240) cytosolic TERT antigen (TERT$_{\Delta240}$ or TERT$_{\Delta541}$) to elicit Ag-specific T and B cell responses to all three encoded cancer antigens.

Immune Response Study in C57BU6J Mice Using Electroporation Study Design. 48 female C57BU6J mice were immunized with triple-antigen DNA constructs encoding human MUC1, cMSLN, and TERT$_{\Delta240}$. The triple-antigen DNA construct (100 ug) was delivered intramuscularly bilaterally (20 ul total into each tibialis anterior muscle) with concomitant electroporation in a prime/boost regimen, two weeks apart between each vaccination. MUC1-, MSLN-, and TERT-specific cellular responses, and MUC1- and MSLN-specific humoral responses were measured 7 days after the last immunization in an IFN-γ ELISpot assay and ELISA assay, respectively. In total, six different triple-antigen DNA constructs encoding all three antigens linked by 2A peptides were used as follows: MUC1-2A-cMSLN-2A-TERT$_{\Delta240}$ (Plasmid 1317), MUC1-2A-TERT$_{\Delta240}$-2A-cMSLN (Plasmid 1318), cMSLN-2A-MUC1-2A-TERT$_{\Delta240}$ (Plasmid 1319), cMSLN-2A-TERT$_{\Delta240}$-2A-MUC1 (Plasmid 1320), TERT$_{\Delta240}$-2A-cMSLN-2A-MUC1 (Plasmid 1321), TERT$_{\Delta240}$-2A-MUC1-2A-cMSLN (Plasmid 1322) (see also Example 10). Results. Table 11 shows the ELISpot data from C57BL/6J splenocytes cultured with peptide pools derived from the MUC1, MSLN, and TERT peptide libraries (see also Peptide Pools Table (Table 18) and Tables 15-17), and the ELISA data from C57BL/6J mouse sera. A positive response is defined as having SFC>100 and IgG titers >99. Numbers in columns 3, 5 and 7 represent # IFN-γ spots/$10^6$ splenocytes after restimulation with MUC1, MSLN and TERT peptide pools and background subtraction, respectively. Numbers in bold font indicates that at least 1 peptide pool tested was too numerous to count, therefore the true figure is at least the value stated. Numbers in columns 4 and 6 represent the anti-MUC1 and MSLN IgG titer, respectively (Optical Density (O.D)=1, Limit of Detection (L.O.D)=99.0). As shown in Table 11, the immunogenic MUC1, MSLN, and TERT polypeptides made with the MUC1-, MSLN-, and TERT-expressing triple-antigen constructs are capable of inducing T cell responses against all three antigens, and B cell responses against MUC1, in contrast, only triple-antigen constructs Plasmids 1317, 1318, and 1322 are capable of inducing B cell responses against MSLN.

TABLE 11

T and B cell responses induced by the triple-antigen DNA constructs (1317-1322) encoding human native full-length membrane-bound MUC1, human cytosolic MSLN, and human truncated (Δ240) cytosolic TERT antigens in C57BL/6J mice

| Construct ID | Animal | MUC1 | | MSLN | | TERT |
|---|---|---|---|---|---|---|
| | | # IFN-γ spots/$10^6$ splenocytes | IgG titer | # IFN-γ spots/$10^6$ splenocytes | IgG titer | # IFN-γ spots/$10^6$ splenocytes |
| Plasmid 1317 | 1 | 1433 | 1772.7 | 369 | 3069.8 | 2920 |
| | 2 | 1979 | 5214.6 | 2764 | 9420.3 | 3133 |
| | 3 | 1729 | 3229.9 | 464 | 6205.6 | 2413 |

TABLE 11-continued

T and B cell responses induced by the triple-antigen DNA constructs (1317-1322) encoding human native full-length membrane-bound MUC1, human cytosolic MSLN, and human truncated (Δ240) cytosolic TERT antigens in C57BL/6J mice

| Construct ID | Animal | MUC1 # IFN-γ spots/$10^6$ splenocytes | MUC1 IgG titer | MSLN # IFN-γ spots/$10^6$ splenocytes | MSLN IgG titer | TERT # IFN-γ spots/$10^6$ splenocytes |
|---|---|---|---|---|---|---|
| | 4 | 1570 | 3220.1 | 1108 | 3892.8 | 3255 |
| | 5 | 1023 | 3837.1 | 497 | 11621.6 | 2293 |
| | 6 | 1509 | 5573.0 | 898 | 2804.0 | 2817 |
| | 7 | 1095 | 3905.2 | 163 | 1745.6 | 2311 |
| | 8 | 1778 | 5147.2 | 2140 | 7709.5 | 3233 |
| Plasmid 1319 | 9 | 842 | 7873.1 | 652 | 99.0 | 2875 |
| | 10 | 1443 | 8987.3 | 760 | 99.0 | 3652 |
| | 11 | 2832 | 7789.4 | 343 | 99.0 | 3510 |
| | 12 | 1797 | 13430.0 | 603 | 99.0 | 3863 |
| | 13 | 1351 | 9923.4 | 901 | 99.0 | 3443 |
| | 14 | 1626 | 3242.3 | 917 | 99.0 | 3541 |
| | 15 | 829 | 7361.0 | 563 | 99.0 | 3003 |
| | 16 | 1165 | 6143.4 | 871 | 99.0 | 3080 |
| Plasmid 1318 | 17 | 475 | 1352.7 | 160 | 194.3 | 704 |
| | 18 | 1027 | 6933.6 | 188 | 99.0 | 2413 |
| | 19 | 1424 | 1886.9 | 557 | 213.2 | 2244 |
| | 20 | 2241 | 3864.1 | 597 | 326.3 | 2799 |
| | 21 | 1447 | 5095.6 | 240 | 1926.4 | 2787 |
| | 22 | 789 | 3992.6 | 116 | 1198.2 | 2455 |
| | 23 | 700 | 4968.0 | 195 | 3040.2 | 2221 |
| | 24 | 1584 | 5403.9 | 231 | 3017.3 | 3310 |
| Plasmid 1320 | 25 | 2043 | 4173.3 | 908 | 99.0 | 4896 |
| | 26 | 2307 | 4158.6 | 1609 | 99.0 | 4532 |
| | 27 | 2271 | 10258.5 | 1281 | 99.0 | 3807 |
| | 28 | 829 | 6768.5 | 243 | 99.0 | 2420 |
| | 29 | 1355 | 7163.9 | 624 | 99.0 | 2993 |
| | 30 | 1938 | 7404.1 | 673 | 99.0 | 3214 |
| | 31 | 1373 | 3941.5 | 386 | 99.0 | 3139 |
| | 32 | 1581 | 7843.7 | 393 | 99.0 | 3745 |
| Plasmid 1321 | 33 | 964 | 5579.2 | 225 | 99.0 | 2500 |
| | 34 | 690 | 6364.0 | 141 | 99.0 | 2674 |
| | 35 | 923 | 8861.3 | 99 | 99.0 | 2492 |
| | 36 | 767 | 10270.5 | 573 | 99.0 | 2467 |
| | 37 | 1039 | 3211.9 | 148 | 99.0 | 1785 |
| | 38 | 1283 | 8614.10 | 308 | 99.0 | 2042 |
| | 39 | 1929 | 15147.2 | 276 | 99.0 | 2805 |
| | 40 | 529 | 3581.12 | 199 | 99.0 | 1412 |
| Plasmid 1322 | 41 | 1017 | 5933.07 | 281 | 7430.2 | 2702 |
| | 42 | 1936 | 5333.3 | 271 | 112.5 | 3317 |
| | 43 | 1719 | 3113.3 | 484 | 7054.2 | 3711 |
| | 44 | 994 | 4422.0 | 254 | 4499.5 | 2797 |
| | 45 | 1824 | 3902.0 | 1710 | 3246.3 | 5541 |
| | 46 | 1435 | 1189.9 | 416 | 1122.6 | 4654 |
| | 47 | 2430 | 686.7 | 613 | 99.0 | 4548 |
| | 48 | 1931 | 7288.6 | 1665 | 2088.1 | 4408 |

Immune Response Study in C57BL/6J Mice Using Adenoviral Vectors

Study Design.

36 female C57BL/6J mice were primed with triple-antigen adenoviral vectors encoding human MUC1, cMSLN, and TERT$_{\Delta240}$ or TERT$_{\Delta541}$, at 1e10 viral particles by intramuscular injection (50 ul). 28 days later, animals were boosted with triple-antigen DNA constructs (50 ug) delivered intramuscularly bilaterally (20 ul total into each tibialis anterior muscle) with concomitant electroporation. MUC1-, MSLN-, and TERT-specific cellular responses, and MUC1- and MSLN-specific humoral responses were measured 7 days after the last immunization in an IFN-γ ELISpot and ICS assay, and an ELISA assay, respectively. In total, three triple-antigen adenoviral and DNA constructs encoding MUC1, cMSLN, and TERT$_{\Delta240}$ linked by 2A peptides, and three triple-antigen adenoviral and DNA constructs encoding MUC1, cMSLN, and TERT$_{\Delta541}$ linked by 2A peptides were used as follows: MUC1-2A-cMSLN-2A-TERT$_{\Delta240}$ (Plasmid 1317), cMSLN-2A-MUC1-2A-TERT$_{\Delta240}$ (Plasmid 1319), cMSLN-2A-TERT$_{\Delta240}$-2A-MUC1 (Plasmid 1320), and MUC1-2A-cMSLN-2A-TERT$_{\Delta541}$ (Plasmid 1351), cMSLN-2A-MUC1-2A-TERT$_{\Delta541}$ (Plasmid 1352), cMSLN-2A-TERT$_{\Delta541}$-2A-MUC1 (Plasmid 1353) (see also Example 10).

Results.

Table 12 shows the ELISpot data from C57BL/6J splenocytes cultured with peptide pools derived from the MUC1, MSLN, and TERT peptide libraries (see also Peptide Pools Table (Table 18) and Tables 15-17), the ICS data from C57BL/6J splenocytes cultured with TERT peptide aa1025-1039, and the ELISA data from C57BL/6J mouse sera. A positive response is defined as having SFC>100, a frequency of IFN-γ$^+$ CD8$^+$ T cells >0.1%, and IgG titers >99. Numbers in columns 3, 5, and 7 represent # IFN-γ spots/$10^6$ splenocytes after restimulation with MUC1, MSLN and TERT peptide pools, and background subtraction, respectively. Numbers in bold font indicate that at least 1 peptide pool tested was too numerous to count, therefore the true figure is at least the value stated. Numbers in column 8 represent # IFN-γ+ CD8+ T cells/10⁶ CD8+ T cells after restimulation with TERT-specific peptide TERT aa1025-1039, and background subtraction. Numbers in columns 4 and 6 represent the anti-MUC1 and anti-MSLN IgG titer, respectively (Optical Density (O.D)=1, Limit of Detection (L.O.D)=99.0). As shown in Table 12, the immunogenic MUC1, MSLN, and TERT polypeptides made with MUC1-, MSLN-, and TERT-expressing triple-antigen constructs are capable of inducing T cell responses against all three antigens, and B cell responses against MUC1; in contrast, only triple-antigen constructs 1317 and 1351 are capable of inducing B cell responses against MSLN.

TABLE 12A

MUC1-specific T and B cell responses induced by the triple-antigen adenoviral AdC68Y and DNA constructs (Plasmids 1317, 1319, and 1320) encoding human native full-length membrane-bound MUC1, human cytosolic MSLN, and human truncated (Δ240) cytosolic TERT antigens, and by the triple-antigen adenoviral AdC68Y and DNA constructs (Plasmids 1351-1353) encoding human native full-length membrane-bound MUC1, human cytosolic MSLN, and human truncated (Δ541) cytosolic TERT antigens in C57BL/6J mice

| | | MUC1 | |
|---|---|---|---|
| Construct ID | Animal # | # IFN-γ spots/10⁶ splenocytes | IgG titer |
| Plasmid 1317 | 19 | 3119 | 11653.4 |
| | 20 | 3347 | 11941.0 |
| | 21 | 1712 | 7287.2 |
| | 22 | 3604 | 14391.7 |
| | 23 | 2349 | 12599.0 |
| | 24 | 2457 | 12969.1 |
| Plasmid 1319 | 25 | 1865 | 15018.2 |
| | 26 | 1661 | 8836.8 |
| | 27 | 1657 | 13335.1 |
| | 28 | 1933 | 17854.1 |
| | 29 | 1293 | 10560.2 |
| | 30 | 2035 | 10477.6 |
| Plasmid 1320 | 31 | 2377 | 2667.4 |
| | 32 | 1629 | 11322.4 |
| | 33 | 1632 | 9562.9 |
| | 34 | 1259 | 7092.0 |
| | 35 | 2024 | 11306.8 |
| | 36 | 861 | 1785.1 |
| Plasmid 1351 | 37 | 2615 | 10253.1 |
| | 38 | 1595 | 13535.4 |
| | 39 | 1889 | 14557.4 |
| | 40 | 1869 | 15470.1 |
| | 41 | 1979 | 11944.4 |
| | 42 | 1892 | 18093.0 |
| Plasmid 1352 | 43 | 1593 | 22002.4 |
| | 44 | 2133 | 11821.6 |
| | 45 | 1341 | 48297.5 |
| | 46 | 1673 | 8682.2 |
| | 47 | 1933 | 11621.7 |
| | 48 | 1767 | 19318.1 |
| Plasmid 1353 | 49 | 1859 | 4826.7 |
| | 50 | 1845 | 3060.0 |
| | 51 | 1784 | 4499.9 |
| | 52 | 2209 | 2940.9 |
| | 53 | 2177 | 7738.32 |
| | 54 | 1821 | 2985.5 |

TABLE 12B

MSLN-specific T and B cell responses induced by the triple-antigen adenoviral AdC68Y and DNA constructs (Plasmids 1317, 1319, and 1320) encoding human native full-length membrane-bound MUC1, human cytosolic MSLN, and human truncated (Δ240) cytosolic TERT antigens, and by the triple-antigen adenoviral AdC68Y and DNA constructs (Plasmids 1351-1353) encoding human native full-length membrane-bound MUC1, human cytosolic MSLN, and human truncated (Δ541) cytosolic TERT antigens in C57BL/6J mice

| | | MSLN | |
|---|---|---|---|
| Construct ID | Animal # | # IFN-γ spots/10⁶ splenocytes | IgG titer |
| Plasmid 1317 | 19 | 856 | 99.0 |
| | 20 | 911 | 1581.9 |
| | 21 | 336 | 1401.2 |
| | 22 | 820 | 767.3 |
| | 23 | 721 | 99.0 |
| | 24 | 1067 | 99.0 |
| Plasmid 1319 | 25 | 708 | 99.0 |
| | 26 | 368 | 99.0 |
| | 27 | 769 | 99.0 |
| | 28 | 1620 | 99.0 |
| | 29 | 880 | 99.0 |
| | 30 | 427 | 99.0 |
| Plasmid 1320 | 31 | 424 | 99.0 |
| | 32 | 399 | 99.0 |
| | 33 | 289 | 99.0 |
| | 34 | 321 | 99.0 |
| | 35 | 540 | 99.0 |
| | 36 | 316 | 99.0 |
| Plasmid 1351 | 37 | 685 | 99.0 |
| | 38 | 804 | 281.3 |
| | 39 | 505 | 155.8 |
| | 40 | 333 | 99.0 |
| | 41 | 285 | 2186.7 |
| | 42 | 444 | 99.0 |
| Plasmid 1352 | 43 | 1504 | 99.0 |
| | 44 | 421 | 99.0 |
| | 45 | 1293 | 99.0 |
| | 46 | 581 | 99.0 |
| | 47 | 747 | 99.0 |
| | 48 | 821 | 99.0 |
| Plasmid 1353 | 49 | 984 | 99.0 |
| | 50 | 740 | 99.0 |
| | 51 | 412 | 99.0 |
| | 52 | 1266 | 99.0 |
| | 53 | 764 | 99.0 |
| | 54 | 432 | 99.0 |

TABLE 12 C

TERT-specific T cell responses induced by the triple-antigen adenoviral AdC68Y and DNA constructs (Plasmids 1317, 1319, and 1320) encoding human native full-length membrane-bound MUC1, human cytosolic MSLN, and human truncated (Δ240) cytosolic TERT antigens, and by the triple-antigen adenoviral AdC68Y and DNA constructs (Plasmids 1351-1353) encoding human native full-length membrane-bound MUC1, human cytosolic MSLN, and human truncated (Δ541) cytosolic TERT antigens in C57BL/6J mice

| | | TERT | |
|---|---|---|---|
| Construct ID | Animal # | # IFN-γ spots/10⁶ splenocytes | % CD8+ T cells being IFN-γ+ |
| Plasmid 1317 | 19 | 5730 | 4.1 |
| | 20 | 4119 | 2.0 |
| | 21 | 4587 | 4.9 |
| | 22 | 5522 | 4.3 |
| | 23 | 5120 | 3.6 |
| | 24 | 4383 | 4.5 |
| Plasmid 1319 | 25 | 4995 | 3.1 |
| | 26 | 4628 | 7.1 |
| | 27 | 2892 | 2.7 |

TABLE 12 C-continued

TERT-specific T cell responses induced by the triple-antigen adenoviral AdC68Y and DNA constructs (Plasmids 1317, 1319, and 1320) encoding human native full-length membrane-bound MUC1, human cytosolic MSLN, and human truncated (Δ240) cytosolic TERT antigens, and by the triple-antigen adenoviral AdC68Y and DNA constructs (Plasmids 1351-1353) encoding human native full-length membrane-bound MUC1, human cytosolic MSLN, and human truncated (Δ541) cytosolic TERT antigens in C57BL/6J mice

| Construct ID | Animal # | TERT # IFN-γ spots/$10^6$ splenocytes | % $CD8^+$ T cells being IFN-γ$^+$ |
|---|---|---|---|
|  | 28 | 4977 | 4.7 |
|  | 29 | 3913 | 5.2 |
|  | 30 | 3153 | 2.9 |
| Plasmid 1320 | 31 | 3732 | 3.6 |
|  | 32 | 4308 | 4.3 |
|  | 33 | 4153 | 1.4 |
|  | 34 | 5067 | 5.2 |
|  | 35 | 5351 | 5.1 |
|  | 36 | 3268 | 5.0 |
| Plasmid 1351 | 37 | 3766 | 2.4 |
|  | 38 | 5805 | 7.7 |
|  | 39 | 4391 | 4.7 |
|  | 40 | 3401 | 2.7 |
|  | 41 | 3874 | 4.0 |
|  | 42 | 3260 | 2.5 |
| Plasmid 1352 | 43 | 5235 | 5.0 |
|  | 44 | 2853 | 3.4 |
|  | 45 | 2876 | 3.5 |
|  | 46 | 2610 | 3.3 |
|  | 47 | 3275 | 2.8 |
|  | 48 | 3009 | 3.3 |
| Plasmid 1353 | 49 | 5806 | 9.1 |
|  | 50 | 6114 | 6.1 |
|  | 51 | 4759 | 6.5 |
|  | 52 | 5157 | 4.8 |
|  | 53 | 3999 | 2.9 |
|  | 54 | 4719 | 3.3 |

Immune Response Study in HLA-A24 Mice

Study Design.

Eight mixed gender HLA-A24 mice were primed with an adenoviral AdC68Y triple-antigen construct (Plasmid 1317; MUC1-2A-cMSLN-2A-TERT$_{Δ240}$) encoding human MUC1, cMSLN, and TERT$_{Δ240}$ at 1e10 viral particles by intramuscular injection (50 ul into each tibialis anterior muscle). 14 days later, animals were boosted intramuscularly with 50 ug triple-antigen DNA construct (Plasmid 1317) encoding the same three antigens (20 ul delivered into each tibialis anterior muscle with concomitant electroporation). HLA-A24-restricted MUC1-specific cellular responses were measured 7 days after the last immunization in an IFN-γ ELISpot assay.

Results.

Table 13 shows the ELISpot data from HLA-A24 splenocytes cultured with the MUC1 peptide aa524-532. A positive response is defined as having SFC>50. Numbers in column 3 represent # IFN-γ spots/$10^6$ splenocytes after restimulation with MUC1 peptide aa524-532 and background subtraction. As shown in Table 13, the immunogenic MUC1 polypeptides made with the MUC1-, MSLN-, and TERT-expressing triple-antigen construct 1317 are capable of inducing HLA-A24-restricted MUC1 peptide aa524-532-specific $CD8^+$ T cell responses. Importantly, T cell responses derived from cancer patients against this specific MUC1 peptide have been shown to correlate with anti-tumor efficacy in vitro (Jochems C et al., Cancer Immunol Immunother (2014) 63:161-174) demonstrating the importance of raising cellular responses against this specific epitope.

TABLE 13

HLA-A24-restricted MUC1 peptide aa524-532-specific T cell responses induced by the triple-antigen adenoviral and DNA constructs Plasmid 1317 (MUC1-2A-cMSLN-2A-TERT$_{Δ240}$) encoding human native full-length membrane-bound MUC1, human cytosolic MSLN, and human truncated (Δ240) cytosolic TERT antigens in HLA-A24 mice

| Construct ID | Animal # | # IFN-γ spots/$10^6$ splenocytes |
|---|---|---|
| Plasmid 1317 | 89 | 89 |
|  | 90 | 289 |
|  | 91 | 291 |
|  | 92 | 207 |
|  | 93 | 83 |
|  | 94 | 295 |
|  | 95 | 82 |
|  | 96 | 100 |

Immune Response Study in Monkeys

Study Design.

24 Chinese cynomolgus macaques were primed with AdC68Y adenoviral vectors encoding human native full-length membrane-bound MUC1 (MUC1), human cytoplasmic MSLN (cMSLN), and human truncated (Δ240) cytosolic TERT (TERT$_{Δ240}$) antigens at 2e11 viral particles by bilateral intramuscular injection (1 mL total). 28 and 56 days later, animals were boosted with DNA encoding the same three antigens delivered intramuscularly bilaterally via electroporation (2 mL total). Anti-CTLA-4 was administered subcutaneously on days 1 (32 mg), 29 (50 mg) and 57 (75 mg). 21 days after the last immunization, animals were bled and PBMCs and serum isolated to assess MUC1-, MSLN-, and TERT-specific cellular (ELISpot, ICS) and MUC1- and MSLN-specific humoral (ELISA) responses, respectively. In total, three triple-antigen adenoviral and DNA constructs encoding MUC1, cMSLN, and TERT$_{Δ240}$ linked by 2A peptides were evaluated: MUC1-2A-cMSLN-2A-TERT$_{Δ240}$ (Plasmid 1317), cMSLN-2A-MUC1-2A-TERT$_{Δ240}$ (Plasmid 1319), and cMSLN-2A-TERT$_{Δ240}$-2A-MUC1 (Plasmid 1320).

Results.

Tables 14A, 14B, and 14C show the ELISpot and ICS data from Chinese cynomolgus macaques' PBMCs cultured with peptide pools derived from the MUC1, MSLN, and TERT peptide libraries (see also Peptide Pools Table (Table 18) and Tables 15-17), and the ELISA data from Chinese cynomolgus macaques' sera. A positive response is defined as having SFC>50, IFN-γ$^+$ $CD8^+$ T cells/1e6 $CD8^+$ T cells >50, and IgG titers >99. Numbers in columns 3, 6, and 9 represent # IFN-γ spots/$10^6$ splenocytes after restimulation with MUC1, MSLN, and TERT peptide pools, and background subtraction, respectively. Numbers in bold font indicate that at least 1 peptide pool tested was too numerous to count, therefore the true figure is at least the value stated. Numbers in columns 4, 7, and 10 represent # IFN-γ$^+$ $CD8^+$ T cells/$10^6$ $CD8^+$ T cells after restimulation with MUC1, MSLN, and TERT peptide pools, respectively, and background subtraction. Numbers in column 5 and 8 represent the anti-MUC1 and anti-MSLN IgG titer (Optical Density (O.D)=1, Limit of Detection (L.O.D)=99.0), respectively. As shown in Table 14, the immunogenic MUC1, MSLN, and TERT polypeptides made with MUC1-, MSLN-, and TERT-expressing triple-Ag constructs are capable of inducing cellular responses against all three antigens, and humoral responses against MUC1. However, only triple-antigen construct 1317 is able to induce significant MSLN-specific B cell responses.

TABLE 14A

MUC1-specific T and B cell responses induced by the triple-antigen adenoviral AdC68Y and DNA constructs (Plasmids 1317, 1319, and 1320) encoding human native full-length membrane-bound MUC1, human cytoplasmic MSLN, and human truncated (Δ240) cytosolic TERT antigens in Chinese cynomolgus macaques

| | | MUC1 | | |
| --- | --- | --- | --- | --- |
| Construct ID | Animal # | # IFN-γ spots/$10^6$ splenocytes | # IFN-γ$^+$ CD8$^+$ T cells/1e6 CD8$^+$ T cells | IgG titer |
| Plasmid 1317 | 4001 | 1319 | 0.0 | 27565.9 |
| | 4002 | 2664 | 48690.6 | 55784.5 |
| | 4003 | 373 | 322.3 | 16151.0 |
| | 4004 | 1617 | 8476.8 | 29970.0 |
| | 4501 | 2341 | 1359.0 | 24289.1 |
| | 4502 | 1157 | 0.0 | 21841.4 |
| | 4503 | 2286 | 3071.1 | 63872.6 |
| | 4504 | 1638 | 2172.4 | 45515.2 |
| Plasmid 1319 | 5001 | 88 | 0.0 | 22857.2 |
| | 5002 | 1308 | 0.0 | 29024.8 |
| | 5003 | 294 | 0.0 | 13356.0 |
| | 5004 | 527 | 468.8 | 15029.1 |
| | 5501 | 1296 | 2088.2 | 44573.6 |
| | 5502 | 1377 | 6624.2 | 23185.5 |
| | 5503 | 1302 | 0.0 | 25699.1 |
| | 5504 | 2499 | 10403.1 | 14456.8 |
| Plasmid 1320 | 6001 | 486 | 0.0 | 24454.1 |
| | 6002 | 1742 | 412.3 | 31986.3 |
| | 6003 | 1369 | 1154.9 | 23966.8 |
| | 6004 | 1129 | 561.6 | 39738.0 |
| | 6501 | 1673 | 447.4 | 21119.6 |
| | 6502 | 1215 | 0.0 | 18092.2 |
| | 6503 | 1817 | 3332.4 | 16364.6 |
| | 6504 | 1212 | 1157.1 | 17340.2 |

TABLE 14B

MSLN-specific T and B cell responses induced by the triple-antigen adenoviral AdC68Y and DNA constructs (Plasmids 1317, 1319, and 1320) encoding human native full-length membrane-bound MUC1, human cytoplasmic MSLN, and human truncated (Δ240) cytosolic TERT antigens in Chinese cynomolgus macaques

| | | MSLN | | |
| --- | --- | --- | --- | --- |
| Construct ID | Animal # | # IFN-γ spots/$10^6$ splenocytes | # IFN-γ$^+$ CD8$^+$ T cells/1e6 CD8$^+$ T cells | IgG titer |
| Plasmid 1317 | 4001 | 1479 | 3732.4 | 7683.9 |
| | 4002 | 1587 | 1795.3 | 6147.4 |
| | 4003 | 648 | 884.7 | 3197.3 |
| | 4004 | 164 | 0.0 | 4561.3 |
| | 4501 | 2279 | 15469.0 | 6350.0 |
| | 4502 | 1930 | 22480.2 | 11699.5 |
| | 4503 | 1234 | 865.1 | 19065.6 |
| | 4504 | 1543 | 2348.1 | 4492.7 |
| Plasmid 1319 | 5001 | 258 | 426.6 | 99.0 |
| | 5002 | 1855 | 2030.9 | 232.0 |
| | 5003 | 1505 | 642.8 | 99.0 |
| | 5004 | 1275 | 2410.4 | 243.3 |
| | 5501 | 282 | 0.0 | 99.0 |
| | 5502 | 732 | 558.6 | 418.4 |
| | 5503 | 2070 | 4529.3 | 130.9 |
| | 5504 | 871 | 3466.9 | 99.0 |
| Plasmid 1320 | 6001 | 2446 | 6723.2 | 1381 |
| | 6002 | 1953 | 3185.0 | 184.8 |
| | 6003 | 2045 | 4053.7 | 99.0 |
| | 6004 | 395 | 0.0 | 419.3 |
| | 6501 | 1742 | 5813.1 | 322.7 |
| | 6502 | 1617 | 12311.5 | 99.0 |
| | 6503 | 448 | 0.0 | 285.6 |
| | 6504 | 338 | 0.0 | 168.8 |

TABLE 14C

TERT-specific T cell responses induced by the triple-antigen adenoviral AdC68Y and DNA constructs (Plasmids 1317, 1319, and 1320) encoding human native full-length membrane-bound MUC1, human cytoplasmic MSLN, and human truncated (Δ240) cytosolic TERT antigens in Chinese cynomolgus macaques

| | | TERT | |
| --- | --- | --- | --- |
| Construct ID | Animal # | # IFN-γ spots/$10^6$ splenocytes | # IFN-γ$^+$ CD8$^+$ T cells/1e6 CD8$^+$ T cells |
| Plasmid 1317 | 4001 | 1723 | 8843.8 |
| | 4002 | 870 | 658.1 |
| | 4003 | 2128 | 5976.1 |
| | 4004 | 420 | 0.0 |
| | 4501 | 2136 | 999.1 |
| | 4502 | 2342 | 1195.6 |
| | 4503 | 1966 | 6701.1 |
| | 4504 | 2436 | 6985.5 |
| Plasmid 1319 | 5001 | 1018 | 1724.4 |
| | 5002 | 2121 | 713.8 |
| | 5003 | 2184 | 324.3 |
| | 5004 | 822 | 714.4 |
| | 5501 | 462 | 1851.4 |
| | 5502 | 325 | 692.9 |
| | 5503 | 401 | 0.0 |
| | 5504 | 517 | 0.0 |
| Plasmid 1320 | 6001 | 3011 | 8615.5 |
| | 6002 | 2825 | 2002.0 |
| | 6003 | 1489 | 1235.8 |
| | 6004 | 2272 | 2462.2 |
| | 6501 | 2428 | 1362.2 |
| | 6502 | 1875 | 4649.5 |
| | 6503 | 2515 | 8493.2 |
| | 6504 | 2584 | 5171.0 |

TABLE 15

Human MUC1 Peptide Library peptide pools and corresponding amino acid sequences

| Amino Acid Sequence | Peptide # | SEQ ID NO |
| --- | --- | --- |
| MASTPGTQSPFFLLL | 1aAS | 132 |
| TPGTQSPFFLLLLLT | 1bAS | 133 |
| TQSPFFLLLLLTVLT | 2 | 134 |
| FFLLLLLTVLTVVTG | 3 | 135 |
| LLLTVLTVVTGSGHA | 4 | 136 |
| VLTVVTGSGHASSTP | 5 | 137 |
| VTGSGHASSTPGGEK | 6 | 138 |
| GHASSTPGGEKETSA | 7 | 139 |
| STPGGEKETSATQRS | 8 | 140 |
| GEKETSATQRSSVPS | 9 | 141 |
| TSATQRSSVPSSTEK | 10 | 142 |
| QRSSVPSSTEKNAVS | 11 | 143 |
| VPSSTEKNAVSMTSS | 12 | 144 |
| TEKNAVSMTSSVLSS | 13 | 145 |
| AVSMTSSVLSSHSPG | 14 | 146 |
| TSSVLSSHSPGSGSS | 15 | 147 |
| LSSHSPGSGSSTTQG | 16 | 148 |

TABLE 15-continued

Human MUC1 Peptide Library peptide pools and corresponding amino acid sequences

| Amino Acid Sequence | Peptide # | SEQ ID NO |
|---|---|---|
| SPGSGSSTTQGQDVT | 17 | 149 |
| GSSTTQGQDVTLAPA | 18 | 150 |
| TQGQDVTLAPATEPA | 19 | 151 |
| DVTLAPATEPASGSA | 20 | 152 |
| APATEPASGSAATWG | 21 | 153 |
| EPASGSAATWGQDVT | 22 | 154 |
| GSAATWGQDVTSVPV | 23 | 155 |
| TWGQDVTSVPVTRPA | 24 | 156 |
| DVTSVPVTRPALGST | 25 | 157 |
| VPVTRPALGSTTPPA | 26 | 158 |
| RPALGSTTPPAHDVT | 27 | 159 |
| GSTTPPAHDVTSAPD | 28 | 160 |
| PPAHDVTSAPDNKPA | 29 | 161 |
| DVTSAPDNKPAPGST | 30 | 162 |
| APDNKPAPGSTAPPA | 31 | 163 |
| KPAPGSTAPPAHGVT | 32 | 164 |
| GSTAPPAHGVTSAPD | 33 | 165 |
| PPAHGVTSAPDTRPA | 34 | 166 |
| GVTSAPDTRPAPGST | 35 | 167 |
| APDTRPAPGSTAPPA | 36 | 168 |
| RPAPGSTAPPAHGVT | 37 | 169 |
| GVTSAPDTRPALGST | 55 | 170 |
| APDTRPALGSTAPPV | 56 | 171 |
| RPALGSTAPPVHNVT | 57 | 172 |
| GSTAPPVHNVTSASG | 58 | 173 |
| PPVHNVTSASGSASG | 59 | 174 |
| NVTSASGSASGSAST | 60 | 175 |
| ASGSASGSASTLVHN | 61 | 176 |
| ASGSASTLVHNGTSA | 62 | 177 |
| ASTLVHNGTSARATT | 63 | 178 |
| VHNGTSARATTTPAS | 64 | 179 |
| TSARATTTPASKSTP | 65 | 180 |
| ATTTPASKSTPFSIP | 66 | 181 |
| PASKSTPFSIPSHHS | 67 | 182 |
| STPFSIPSHHSDTPT | 68 | 183 |
| SIPSHHSDTPTTLAS | 69 | 184 |
| HHSDTPTTLASHSTK | 70 | 185 |
| TPTTLASHSTKTDAS | 71 | 186 |
| LASHSTKTDASSTHH | 72 | 187 |
| STKTDASSTHHSSVP | 73 | 188 |
| DASSTHHSSVPPLTS | 74 | 189 |
| THHSSVPPLTSSNHS | 75 | 190 |
| SVPPLTSSNHSTSPQ | 76 | 191 |
| LTSSNHSTSPQLSTG | 77 | 192 |
| NHSTSPQLSTGVSFF | 78 | 193 |
| SPQLSTGVSFFFLSF | 79 | 194 |
| STGVSFFFLSFHISN | 80 | 195 |
| SFFFLSFHISNLQFN | 81 | 196 |
| LSFHISNLQFNSSLE | 82 | 197 |
| ISNLQFNSSLEDPST | 83 | 198 |
| QFNSSLEDPSTDYYQ | 84 | 199 |
| SLEDPSTDYYQELQR | 85 | 200 |
| PSTDYYQELQRDISE | 86 | 201 |
| YYQELQRDISEMFLQ | 87 | 202 |
| LQRDISEMFLQIYKQ | 88 | 203 |
| ISEMFLQIYKQGGFL | 89 | 204 |
| FLQIYKQGGFLGLSN | 90 | 205 |
| YKQGGFLGLSNIKFR | 91 | 206 |
| GFLGLSNIKFRPGSV | 92X | 207 |
| LSNIKFRPGSVVVQL | 93X | 208 |
| KFRPGSVVVQLTLAF | 94X | 209 |
| GSVVVQLTLAFREGT | 95X | 210 |
| VVVQLTLAFREGTIN | 95XX | 211 |
| QLTLAFREGTINVHD | 96 | 212 |
| AFREGTINVHDVETQ | 97 | 213 |
| GTINVHDVETQFNQY | 98 | 214 |
| VHDVETQFNQYKTEA | 99 | 215 |
| ETQFNQYKTEAASRY | 100 | 216 |
| NQYKTEAASRYNLTI | 101 | 217 |
| TEAASRYNLTISDVS | 102 | 218 |
| SRYNLTISDVSVSDV | 103 | 219 |
| LTISDVSVSDVPFPF | 104 | 220 |
| DVSVSDVPFPFSAQS | 105 | 221 |
| SDVPFPFSAQSGAGV | 106 | 222 |

TABLE 15-continued

Human MUC1 Peptide Library peptide pools and corresponding amino acid sequences

| Amino Acid Sequence | Peptide # | SEQ ID NO |
|---|---|---|
| FPFSAQSAGVPGVVG | 107 | 223 |
| AQSGAGVPGWGIALL | 108 | 224 |
| AGVPGWGIALLVLVC | 109 | 225 |
| GWGIALLVLVCVLVA | 110 | 226 |
| ALLVLVCVLVALAIV | 111 | 227 |
| LVCVLVALAIVYLIA | 112 | 228 |
| LVALAIVYLIALAVC | 113 | 229 |
| AIVYLIALAVCQCRR | 114 | 230 |
| LIALAVCQCRRKNYG | 115 | 231 |
| AVCQCRRKNYGQLDI | 116 | 232 |
| CRRKNYGQLDIFPAR | 117 | 233 |
| NYGQLDIFPARDTYH | 118 | 234 |
| LDIFPARDTYHPMSE | 119 | 235 |
| PARDTYHPMSEYPTY | 120 | 236 |
| TYHPMSEYPTYHTHG | 121 | 237 |
| MSEYPTYHTHGRYVP | 122 | 238 |
| PTYHTHGRYVPPSST | 123 | 239 |
| THGRYVPPSSTDRSP | 124 | 240 |
| YVPPSSTDRSPYEKV | 125 | 241 |
| SSTDRSPYEKVSAGN | 126 | 242 |
| RSPYEKVSAGNGGSS | 127 | 243 |
| EKVSAGNGGSSLSYT | 128 | 244 |
| AGNGGSSLSYTNPAV | 129 | 245 |
| GSSLSYTNPAVAAAS | 130 | 246 |
| LSYTNPAVAAASANL | 131 | 247 |

TABLE 16

Human MSLN Peptide Library peptide pools and corresponding amino acid sequences

| Amino Acid Sequence | Peptide # | SEQ ID NO |
|---|---|---|
| MASLPTARPLLGSCG | 1aS | 248 |
| TARPLLGSCGTPALG | 2 | 249 |
| LLGSCGTPALGSLLF | 3 | 250 |
| CGTPALGSLLFLLFS | 4 | 251 |
| ALGSLLFLLFSLGWV | 5 | 252 |
| LLFLLFSLGWVQPSR | 6 | 253 |
| LFSLGWVQPSRTLAG | 7 | 254 |

TABLE 16-continued

Human MSLN Peptide Library peptide pools and corresponding amino acid sequences

| Amino Acid Sequence | Peptide # | SEQ ID NO |
|---|---|---|
| GWVQPSRTLAGETGQ | 8 | 255 |
| PSRTLAGETGQEAAP | 9 | 256 |
| TLAGETGQEAAPLDG | 10X | 257 |
| TGQEAAPLDGVLANP | 11 | 258 |
| AAPLDGVLANPPNIS | 12 | 259 |
| DGVLANPPNISSLSP | 13 | 260 |
| ANPPNISSLSPRQLL | 14 | 261 |
| NISSLSPRQLLGFPC | 15 | 262 |
| LSPRQLLGFPCAEVS | 16 | 263 |
| QLLGFPCAEVSGLST | 17 | 264 |
| FPCAEVSGLSTERVR | 18 | 265 |
| EVSGLSTERVRELAV | 19 | 266 |
| LSTERVRELAVALAQ | 20 | 267 |
| RVRELAVALAQKNVK | 21 | 268 |
| LAVALAQKNVKLSTE | 22 | 269 |
| LAQKNVKLSTEQLRC | 23 | 270 |
| NVKLSTEQLRCLAHR | 24 | 271 |
| STEQLRCLAHRLSEP | 25 | 272 |
| LRCLAHRLSEPPEDL | 26 | 273 |
| AHRLSEPPEDLDALP | 27 | 274 |
| SEPPEDLDALPLDLL | 28 | 275 |
| EDLDALPLDLLLFLN | 29 | 276 |
| ALPLDLLLFLNPDAF | 30 | 277 |
| DLLLFLNPDAFSGPQ | 31 | 278 |
| FLNPDAFSGPQACTR | 32 | 279 |
| DAFSGPQACTRFFSR | 33 | 280 |
| GPQACTRFFSRITKA | 34 | 281 |
| CTRFFSRITKANVDL | 35 | 282 |
| FSRITKANVDLLPRG | 36 | 283 |
| TKANVDLLPRGAPER | 37 | 284 |
| VDLLPRGAPERQRLL | 38 | 285 |
| PRGAPERQRLLPAAL | 39 | 286 |
| PERQRLLPAALACWG | 40 | 287 |
| RLLPAALACWGVRGS | 41 | 288 |
| AALACWGVRGSLLSE | 42 | 289 |
| CWGVRGSLLSEADVR | 43 | 290 |
| RGSLLSEADVRALGG | 44 | 291 |

TABLE 16-continued

Human MSLN Peptide Library peptide pools and corresponding amino acid sequences

| Amino Acid Sequence | Peptide # | SEQ ID NO |
|---|---|---|
| LSEADVRALGGLACD | 45 | 292 |
| DVRALGGLACDLPGR | 46 | 293 |
| LGGLACDLPGRFVAE | 47 | 294 |
| ACDLPGRFVAESAEV | 48 | 295 |
| PGRFVAESAEVLLPR | 49 | 296 |
| VAESAEVLLPRLVSC | 50 | 297 |
| AEVLLPRLVSCPGPL | 51 | 298 |
| LPRLVSCPGPLDQDQ | 52 | 299 |
| VSCPGPLDQDQQEAA | 53 | 300 |
| GPLDQDQQEAARAAL | 54 | 301 |
| QDQQEAARAALQGGG | 55 | 302 |
| EAARAALQGGGPPYG | 56 | 303 |
| AALQGGGPPYGPPST | 57 | 304 |
| GGGPPYGPPSTWSVS | 58 | 305 |
| PYGPPSTWSVSTMDA | 59 | 306 |
| PSTWSVSTMDALRGL | 60 | 307 |
| SVSTMDALRGLLPVL | 61 | 308 |
| MDALRGLLPVLGQPI | 62 | 309 |
| RGLLPVLGQPIIRSI | 63 | 310 |
| PVLGQPIIRSIPQGI | 64 | 311 |
| QPIIRSIPQGIVAAW | 65 | 312 |
| RSIPQGIVAAWRQRS | 66 | 313 |
| QGIVAAWRQRSSRDP | 67 | 314 |
| AAWRQRSSRDPSWRQ | 68 | 315 |
| QRSSRDPSWRQPERT | 69 | 316 |
| RDPSWRQPERTILRP | 70 | 317 |
| WRQPERTILRPRFRR | 71 | 318 |
| ERTILRPRFRREVEK | 72 | 319 |
| LRPRFRREVEKTACP | 73 | 320 |
| FRREVEKTACPSGKK | 74 | 321 |
| VEKTACPSGKKAREI | 75 | 322 |
| ACPSGKKAREIDESL | 76 | 323 |
| GKKAREIDESLIFYK | 77 | 324 |
| REIDESLIFYKKWEL | 78 | 325 |
| ESLIFYKKWELEACV | 79 | 326 |
| FYKKWELEACVDAAL | 80 | 327 |
| WELEACVDAALLATQ | 81 | 328 |
| ACVDAALLATQMDRV | 82 | 329 |
| AALLATQMDRVNAIP | 83 | 330 |
| ATQMDRVNAIPFTYE | 84 | 331 |
| DRVNAIPFTYEQLDV | 85 | 332 |
| AIPFTYEQLDVLKHK | 86 | 333 |
| TYEQLDVLKHKLDEL | 87 | 334 |
| LDVLKHKLDELYPQG | 88 | 335 |
| KHKLDELYPQGYPES | 89 | 336 |
| DELYPQGYPESVIQH | 90 | 337 |
| PQGYPESVIQHLGYL | 91 | 338 |
| PESVIQHLGYLFLKM | 92 | 339 |
| IQHLGYLFLKMSPED | 93 | 340 |
| GYLFLKMSPEDIRKW | 94 | 341 |
| LKMSPEDIRKWNVTS | 95 | 342 |
| PEDIRKWNVTSLETL | 96 | 343 |
| RKWNVTSLETLKALL | 97 | 344 |
| VTSLETLKALLEVNK | 98 | 345 |
| ETLKALLEVNKGHEM | 99 | 346 |
| ALLEVNKGHEMSPQV | 100 | 347 |
| VNKGHEMSPQVATLI | 101 | 348 |
| HEMSPQVATLIDRFV | 102 | 349 |
| PQVATLIDRFVKGRG | 103 | 350 |
| TLIDRFVKGRGQLDK | 104 | 351 |
| RFVKGRGQLDKDTLD | 105 | 352 |
| GRGQLDKDTLDTLTA | 106 | 353 |
| LDKDTLDTLTAFYPG | 107 | 354 |
| TLDTLTAFYPGYLCS | 108 | 355 |
| LTAFYPGYLCSLSPE | 109 | 356 |
| YPGYLCSLSPEELSS | 110 | 357 |
| LCSLSPEELSSVPPS | 111 | 358 |
| SPEELSSVPPSSIWA | 112 | 359 |
| LSSVPPSSIWAVRPQ | 113 | 360 |
| PPSSIWAVRPQDLDT | 114 | 361 |
| IWAVRPQDLDTCDPR | 115 | 362 |
| RPQDLDTCDPRQLDV | 116 | 363 |
| LDTCDPRQLDVLYPK | 117 | 364 |
| DPRQLDVLYPKARLA | 118 | 365 |
| LDVLYPKARLAFQNM | 119 | 366 |

TABLE 16-continued

Human MSLN Peptide Library peptide pools and corresponding amino acid sequences

| Amino Acid Sequence | Peptide # | SEQ ID NO |
|---|---|---|
| YPKARLAFQNMNGSE | 120 | 367 |
| RLAFQNMNGSEYFVK | 121 | 368 |
| QNMNGSEYFVKIQSF | 122 | 369 |
| GSEYFVKIQSFLGGA | 123 | 370 |
| FVKIQSFLGGAPTED | 124 | 371 |
| QSFLGGAPTEDLKAL | 125 | 372 |
| GGAPTEDLKALSQQN | 126 | 373 |
| TEDLKALSQQNVSMD | 127 | 374 |
| KALSQQNVSMDLATF | 128 | 375 |
| QQNVSMDLATFMKLR | 129 | 376 |
| SMDLATFMKLRTDAV | 130 | 377 |
| ATFMKLRTDAVLPLT | 131 | 378 |
| KLRTDAVLPLTVAEV | 132 | 379 |
| DAVLPLTVAEVQKLL | 133 | 380 |
| PLTVAEVQKLLGPHV | 134 | 381 |
| AEVQKLLGPHVEGLK | 135 | 382 |
| KLLGPHVEGLKAEER | 136 | 383 |
| PHVEGLKAEERHRPV | 137 | 384 |
| GLKAEERHRPVRDWI | 138 | 385 |
| EERHRPVRDWILRQR | 139 | 386 |
| RPVRDWILRQRQDDL | 140 | 387 |
| DWILRQRQDDLDTLG | 141 | 388 |
| RQRQDDLDTLGLGLQ | 142 | 389 |
| DDLDTLGLGLQGGIP | 143 | 390 |
| TLGLGLQGGIPNGYL | 144 | 391 |
| GLQGGIPNGYLVLDL | 145 | 392 |
| GIPNGYLVLDLSMQE | 146 | 393 |
| YLVLDLSMQEALSGT | 147XX | 394 |
| LDLSMQEALSGTPCL | 148 | 395 |
| MQEALSGTPCLLGPG | 149 | 396 |
| LSGTPCLLGPGPVLT | 150 | 397 |
| PCLLGPGPVLTVLAL | 151 | 398 |
| GPGPVLTVLALLLAS | 152 | 399 |
| PVLTVLALLLASTLA | 153 | 400 |

TABLE 17

Human TERT Peptide Library peptide pools and corresponding amino acid sequences

| Amino Acid Sequence | Peptide # | SEQ ID NO |
|---|---|---|
| RRGAAPEPERTPVGQ | 61 | 401 |
| APEPERTPVGQGSWA | 62 | 402 |
| ERTPVGQGSWAHPGR | 63 | 403 |
| VGQGSWAHPGRTRGP | 64 | 404 |
| SWAHPGRTRGPSDRG | 65 | 405 |
| PGRTRGPSDRGFCVV | 66 | 406 |
| RGPSDRGFCVVSPAR | 67 | 407 |
| DRGFCVVSPARPAEE | 68 | 408 |
| CVVSPARPAEEATSL | 69 | 409 |
| PARPAEEATSLEGAL | 70 | 410 |
| AEEATSLEGALSGTR | 71 | 411 |
| TSLEGALSGTRHSHP | 72 | 412 |
| GALSGTRHSHPSVGR | 73 | 413 |
| GTRHSHPSVGRQHHA | 74 | 414 |
| SHPSVGRQHHAGPPS | 75 | 415 |
| VGRQHHAGPPSTSRP | 76 | 416 |
| HHAGPPSTSRPPRPW | 77 | 417 |
| PPSTSRPPRPWDTPC | 78 | 418 |
| SRPPRPWDTPCPPVY | 79 | 419 |
| RPWDTPCPPVYAETK | 80 | 420 |
| TPCPPVYAETKHFLY | 81 | 421 |
| PVYAETKHFLYSSGD | 82 | 422 |
| ETKHFLYSSGDKEQL | 83 | 423 |
| FLYSSGDKEQLRPSF | 84 | 424 |
| SGDKEQLRPSFLLSS | 85 | 425 |
| EQLRPSFLLSSLRPS | 86 | 426 |
| PSFLLSSLRPSLTGA | 87 | 427 |
| LSSLRPSLTGARRLV | 88 | 428 |
| RPSLTGARRLVETIF | 89 | 429 |
| TGARRLVETIFLGSR | 90 | 430 |
| RLVETIFLGSRPWMP | 91 | 431 |
| TIFLGSRPWMPGTPR | 92 | 432 |
| GSRPWMPGTPRRLPR | 93 | 433 |
| WMPGTPRRLPRLPQR | 94 | 434 |
| TPRRLPRLPQRYWQM | 95 | 435 |
| LPRLPQRYWQMRPLF | 96 | 436 |
| PQRYWQMRPLFLELL | 97 | 437 |

TABLE 17-continued

Human TERT Peptide Library peptide pools and corresponding amino acid sequences

| Amino Acid Sequence | Peptide # | SEQ ID NO |
|---|---|---|
| WQMRPLFLELLGNHA | 98 | 438 |
| PLFLELLGNHAQCPY | 99 | 439 |
| ELLGNHAQCPYGVLL | 100 | 440 |
| NHAQCPYGVLLKTHC | 101 | 441 |
| CPYGVLLKTHCPLRA | 102 | 442 |
| VLLKTHCPLRAAVTP | 103 | 443 |
| THCPLRAAVTPAAGV | 104 | 444 |
| LRAAVTPAAGVCARE | 105 | 445 |
| VTPAAGVCAREKPQG | 106 | 446 |
| AGVCAREKPQGSVAA | 107 | 447 |
| AREKPQGSVAAPEEE | 108 | 448 |
| PQGSVAAPEEEDTDP | 109 | 449 |
| VAAPEEEDTDPRRLV | 110 | 450 |
| EEEDTDPRRLVQLLR | 111 | 451 |
| TDPRRLVQLLRQHSS | 112 | 452 |
| RLVQLLRQHSSPWQV | 113 | 453 |
| LLRQHSSPWQVYGFV | 114 | 454 |
| HSSPWQVYGFVRACL | 115 | 455 |
| WQVYGFVRACLRRLV | 116 | 456 |
| GFVRACLRRLVPPGL | 117 | 457 |
| ACLRRLVPPGLWGSR | 118 | 458 |
| RLVPPGLWGSRHNER | 119 | 459 |
| PGLWGSRHNERRFLR | 120 | 460 |
| GSRHNERRFLRNTKK | 121 | 461 |
| NERRFLRNTKKFISL | 122 | 462 |
| FLRNTKKFISLGKHA | 123 | 463 |
| TKKFISLGKHAKLSL | 124 | 464 |
| ISLGKHAKLSLQELT | 125 | 465 |
| KHAKLSLQELTWKMS | 126 | 466 |
| LSLQELTWKMSVRDC | 127 | 467 |
| ELTWKMSVRDCAWLR | 128 | 468 |
| KMSVRDCAWLRRSPG | 129 | 469 |
| RDCAWLRRSPGVGCV | 130 | 470 |
| WLRRSPGVGCVPAAE | 131 | 471 |
| SPGVGCVPAAEHRLR | 132 | 472 |
| GCVPAAEHRLREEIL | 133 | 473 |
| AAEHRLREEILAKFL | 134 | 474 |
| RLREEILAKFLHWLM | 135 | 475 |
| EILAKFLHWLMSVYV | 136 | 476 |
| KFLHWLMSVYVVELL | 137 | 477 |
| WLMSVYVVELLRSFF | 138 | 478 |
| VYVVELLRSFFYVTE | 139 | 479 |
| ELLRSFFYVTETTFQ | 140 | 480 |
| SFFYVTETTFQKNRL | 141 | 481 |
| VTETTFQKNRLFFYR | 142 | 482 |
| TFQKNRLFFYRKSVW | 143 | 483 |
| NRLFFYRKSVWSKLQ | 144 | 484 |
| FYRKSVWSKLQSIGI | 145 | 485 |
| SVWSKLQSIGIRQHL | 146 | 486 |
| KLQSIGIRQHLKRVQ | 147 | 487 |
| IGIRQHLKRVQLREL | 148 | 488 |
| QHLKRVQLRELSEAE | 149 | 489 |
| RVQLRELSEAEVRQH | 150 | 490 |
| RELSEAEVRQHREAR | 151 | 491 |
| EAEVRQHREARPALL | 152 | 492 |
| RQHREARPALLTSRL | 153 | 493 |
| EARPALLTSRLRFIP | 154 | 494 |
| ALLTSRLRFIPKPDG | 155 | 495 |
| SRLRFIPKPDGLRPI | 156 | 496 |
| FIPKPDGLRPIVNMD | 157 | 497 |
| PDGLRPIVNMDYVVG | 158 | 498 |
| RPIVNMDYVVGARTF | 159 | 499 |
| NMDYVVGARTFRREK | 160 | 500 |
| VVGARTFRREKRAER | 161 | 501 |
| RTFRREKRAERLTSR | 162 | 502 |
| REKRAERLTSRVKAL | 163 | 503 |
| AERLTSRVKALFSVL | 164 | 504 |
| TSRVKALFSVLNYER | 165 | 505 |
| KALFSVLNYERARRP | 166 | 506 |
| SVLNYERARRPGLLG | 167 | 507 |
| YERARRPGLLGASVL | 168 | 508 |
| RRPGLLGASVLGLDD | 169 | 509 |
| LLGASVLGLDDIHRA | 170 | 510 |
| SVLGLDDIHRAWRTF | 171 | 511 |

TABLE 17-continued

Human TERT Peptide Library peptide pools and corresponding amino acid sequences

| Amino Acid Sequence | Peptide # | SEQ ID NO |
|---|---|---|
| LDDIHRAWRTFVLRV | 172 | 512 |
| HRAWRTFVLRVRAQD | 173 | 513 |
| RTFVLRVRAQDPPPE | 174 | 514 |
| LRVRAQDPPPELYFV | 175 | 515 |
| AQDPPPELYFVKVDV | 176 | 516 |
| PPELYFVKVDVTGAY | 177 | 517 |
| YFVKVDVTGAYDTIP | 178 | 518 |
| VDVTGAYDTIPDRL | 179 | 519 |
| GAYDTIPDRLTEVI | 180 | 520 |
| TIPDRLTEVIASII | 181 | 521 |
| DRLTEVIASIIKPQN | 182 | 522 |
| EVIASIIKPQNTYCV | 183 | 523 |
| SIIKPQNTYCVRRYA | 184 | 524 |
| PQNTYCVRRYAVVQK | 185 | 525 |
| YCVRRYAVVQKAAHG | 186 | 526 |
| RYAVVQKAAHGHVRK | 187 | 527 |
| VQKAAHGHVRKAFKS | 188 | 528 |
| AHGHVRKAFKSHVST | 189 | 529 |
| VRKAFKSHVSTLTDL | 190 | 530 |
| FKSHVSTLTDLQPYM | 191 | 531 |
| VSTLTDLQPYMRQFV | 192 | 532 |
| TDLQPYMRQFVAHLQ | 193 | 533 |
| PYMRQFVAHLQETSP | 194 | 534 |
| QFVAHLQETSPLRDA | 195 | 535 |
| HLQETSPLRDAVVIE | 196 | 536 |
| TSPLRDAVVIEQSSS | 197 | 537 |
| RDAVVIEQSSSLNEA | 198 | 538 |
| VIEQSSSLNEASSGL | 199 | 539 |
| SSSLNEASSGLFDVF | 200 | 540 |
| NEASSGLFDVFLRFM | 201 | 541 |
| SGLFDVFLRFMCHHA | 202 | 542 |
| DVFLRFMCHHAVRIR | 203 | 543 |
| RFMCHHAVRIRGKSY | 204 | 544 |
| HHAVRIRGKSYVQCQ | 205 | 545 |
| RIRGKSYVQCQGIPQ | 206 | 546 |
| KSYVQCQGIPQGSIL | 207 | 547 |
| QCQGIPQGSILSTLL | 208 | 548 |
| IPQGSILSTLLCSLC | 209 | 549 |
| SILSTLLCSLCYGDM | 210 | 550 |
| TLLCSLCYGDMENKL | 211 | 551 |
| SLCYGDMENKLFAGI | 212 | 552 |
| GDMENKLFAGIRRDG | 213 | 553 |
| NKLFAGIRRDGLLLR | 214 | 554 |
| AGIRRDGLLLRLVDD | 215 | 555 |
| RDGLLLRLVDDFLLV | 216 | 556 |
| LLRLVDDFLLVTPHL | 217 | 557 |
| VDDFLLVTPHLTHAK | 218 | 558 |
| LLVTPHLTHAKTFLR | 219 | 559 |
| PHLTHAKTFLRTLVR | 220 | 560 |
| HAKTFLRTLVRGVPE | 221 | 561 |
| FLRTLVRGVPEYGCV | 222 | 562 |
| LVRGVPEYGCVVNLR | 223 | 563 |
| VPEYGCVVNLRKTVV | 224 | 564 |
| GCVVNLRKTVVNFPV | 225 | 565 |
| NLRKTVVNFPVEDEA | 226 | 566 |
| TVVNFPVEDEALGGT | 227 | 567 |
| FPVEDEALGGTAFVQ | 228 | 568 |
| DEALGGTAFVQMPAH | 229 | 569 |
| GGTAFVQMPANGLFP | 230 | 570 |
| FVQMPAHGLFPWCGL | 231 | 571 |
| PAHGLFPWCGLLLDT | 232 | 572 |
| LFPWCGLLLDTRTLE | 233 | 573 |
| CGLLLDTRTLEVQSD | 234 | 574 |
| LDTRTLEVQSDYSSY | 235 | 575 |
| TLEVQSDYSSYARTS | 236 | 576 |
| QSDYSSYARTSIRAS | 237 | 577 |
| SSYARTSIRASLTFN | 238 | 578 |
| RTSIRASLTFNRGFK | 239 | 579 |
| RASLTFNRGFKAGRN | 240 | 580 |
| TFNRGFKAGRNMRRK | 241 | 581 |
| GFKAGRNMRRKLFGV | 242 | 582 |
| GRNMRRKLFGVLRLK | 243 | 583 |
| RRKLFGVLRLKCHSL | 244 | 584 |
| FGVLRLKCHSLFLDL | 245 | 585 |

TABLE 17-continued

Human TERT Peptide Library peptide pools and corresponding amino acid sequences

| Amino Acid Sequence | Peptide # | SEQ ID NO |
|---|---|---|
| RLKCHSLFLDLQVNS | 246 | 586 |
| HSLFLDLQVNSLQTV | 247 | 587 |
| LDLQVNSLQTVCTNI | 248 | 588 |
| VNSLQTVCTNIYKIL | 249 | 589 |
| QTVCTNIYKILLLQA | 250 | 590 |
| TNIYKILLLQAYRFH | 251 | 591 |
| KILLLQAYRFHACVL | 252 | 592 |
| LQAYRFHACVLQLPF | 253 | 593 |
| RFHACVLQLPFHQQV | 254 | 594 |
| CVLQLPFHQQVWKNP | 255 | 595 |
| LPFHQQVWKNPTFFL | 256 | 596 |
| QQVWKNPTFFLRVIS | 257 | 597 |
| KNPTFFLRVISDTAS | 258 | 598 |
| FFLRVISDTASLCYS | 259 | 599 |
| VISDTASLCYSILKA | 260 | 600 |
| TASLCYSILKAKNAG | 261 | 601 |
| CYSILKAKNAGMSLG | 262 | 602 |
| LKAKNAGMSLGAKGA | 263 | 603 |
| NAGMSLGAKGAAGPL | 264 | 604 |
| SLGAKGAAGPLPSEA | 265 | 605 |
| KGAAGPLPSEAVQWL | 266 | 606 |
| GPLPSEAVQWLCHQA | 267 | 607 |
| SEAVQWLCHQAFLLK | 268 | 608 |
| QWLCHQAFLLKLTRH | 269 | 609 |
| HQAFLLKLTRHRVTY | 270 | 610 |
| LLKLTRHRVTYVPLL | 271 | 611 |
| TRHRVTYVPLLGSLR | 272 | 612 |
| VTYVPLLGSLRTAQT | 273 | 613 |
| PLLGSLRTAQTQLSR | 274 | 614 |
| SLRTAQTQLSRKLPG | 275 | 615 |
| AQTQLSRKLPGTTLT | 276 | 616 |
| LSRKLPGTTLTALEA | 277 | 617 |
| LPGTTLTALEAAANP | 278 | 618 |
| TLTALEAAANPALPS | 279 | 619 |
| LEAAANPALPSDFKT | 280 | 620 |
| AANPALPSDFKTILD | 281 | 621 |

TABLE 18

Peptide Pools

| Antigen | Peptide Pools |
|---|---|
| MUC1 | 116 sequential 15-mer peptides, overlapping by 11 amino acids, covering amino acids 1-224 and 945-1255 of the MUC1 precursor protein of SEQ ID NO: 1 (amino acid sequence of SEQ ID NO: 8) |
| MSLN | 153 sequential 15-mer peptides, overlapping by 11 amino acids, covering the entire MSLN precursor protein sequence of SEQ ID NO: 2. |
| TERT | 221 sequential 15-mer peptides, overlapping by 11 amino acids, covering the TERT$_{\Delta 240}$ protein sequence of SEQ ID NO: 10 (amino acids 239-1132 of SEQ ID NO: 3 (total 894 amino acids, (excluding the first 238 amino acids of the native full-length TERT recursor protein of SEQ ID NO: 3) |

TABLE 19

2A Peptides

| 2A Peptide | Amino Acid Sequence | SEQ ID NO: |
|---|---|---|
| FMD2A | QTLNFDLLKLAGDVESNPGP | 633 |
| T2A | EGRGSLLTCGDVEENPGP | 634 |
| EMC2A | HYAGYFADLLIHDIETNPGP | 635 |
| ERA2A | QCTNYALLKLAGDVESNPGP | 636 |
| ERB2A | TILSEGATNFSLLKLAGDVELNPGP | 637 |
| PT2A | ATNFSLLKQAGDVEENPGP | 638 |

Example 7. Combination of Vaccines with Immune Modulators

The following example is provided to illustrate enhanced tumor growth inhibition effects when an anti-cancer vaccine was administered in combination with an anti-Cytotoxic T-Lymphocyte Antigen (CTLA4) antibody and/or an indoleamine 2,3-dioxygenase 1 (IDO1) inhibitor.

Study Procedures.

BALB-neuT mice were implanted on study day 0 with TUBO tumor cells by subcutaneous injection. Mice were dosed with 200 mg/Kg of 3-(5-fluoro-1H-indol-3-yl)pyrrolidine-2,5-dione (IDO1 inhibitor) or vehicle twice daily from study day 7 using oral gavage. Comparator groups were sham dosed with vehicle from study day 7 onwards. Appropriated mice were immunized on study day 10 with 1e10 Viral Particles of an adenovirus vector engineered to express rat HER2 (rHER2) (rHER2 vaccine) or vector lacking the rHER2 transgene (control vaccine), by intramuscular injection. Subsequently, 250 ug of an anti-CTLA4 antibody (murine monoclonal antibody to CTLA-4, clone 9D9) or an IgG2 isotype control monoclonal antibody was injected subcutaneously in close proximity to lymph nodes draining the site of adenovirus vector injection. Every two weeks thereafter, mice were immunized with 100 ug of a DNA plasmid encoding rHER2 (rHER2 vaccine) or a DNA plasmid lacking the rHER2 transgene (control vaccine) by electroporation. Subsequent to the DNA plasmid administration, 250 ug of the anti-CTLA4 antibody was injected subcutaneously in close proximity to lymph nodes draining the site of DNA plasmid injection. To track tumor progression, subcutaneous tumor volumes were measured twice a week throughout the study. Animals with subcutaneous tumor volumes that reached 2000 mm3 or displaying irreversible signs of disease were euthanized.

Results.

Subcutaneous tumor volumes of individual animals in each treatment group are presented in Tables 20-A-20-H.

No effect on tumor growth rates was observed in mice treated with the anti-CTLA4 antibody alone or with the 001 inhibitor alone. However, slower growth rates were observed in some of the animals treated with the rHER2 vaccine alone. Mice treated with the rHER2 vaccine in combination with the anti-CTLA4 antibody and mice treated with the rHER2 vaccine in combination with the 001 inhibitor had reduced tumor growth rates compared to the corresponding control animals. Tumor growth inhibition was most pronounced in mice treated with the rHER2 vaccine, the anti-CTLA4 antibody, and the 001 inhibitor.

TABLE 20-A

Subcutaneous tumor volumes from BALB-neuT mice treated with rHER2 vaccine, isotype control antibody, and vehicle

| Study Day | \multicolumn{13}{c}{Animal ID} | | | | | | | | | | | | |
|---|---|---|---|---|---|---|---|---|---|---|---|---|---|
| | 001 | 002 | 003 | 004 | 005 | 006 | 007 | 008 | 009 | 010 | 011 | 012 | 013 |
| 7 | 15.28 | 24.88 | 25.22 | 43.22 | 20.92 | 23.31 | 54.61 | 18.97 | 15.63 | 7.26 | 34.97 | 23.85 | 26.51 |
| 11 | 59.85 | 51.25 | 32.16 | 70.17 | 53.95 | 33.47 | 58.64 | 27.65 | 23.43 | 24.93 | 52.01 | 30.46 | 64.37 |
| 14 | 69.49 | 58.15 | 44.48 | 92.14 | 77.00 | 48.03 | 94.39 | 35.07 | 28.64 | 28.73 | 95.93 | 60.86 | 76.06 |
| 18 | 121.53 | 105.11 | 69.57 | 162.26 | 147.15 | 89.85 | 200.97 | 64.56 | 54.34 | 48.57 | 268.43 | 62.34 | 99.72 |
| 21 | 177.93 | 109.81 | 78.17 | 182.61 | 145.82 | 106.58 | 194.34 | 63.14 | 71.46 | 88.39 | 254.23 | 83.27 | 137.39 |
| 24 | 209.82 | 89.80 | 80.60 | 186.71 | 130.91 | 120.51 | 309.21 | 70.57 | 101.02 | 90.27 | 340.71 | 80.33 | 151.06 |
| 27 | 251.78 | 178.06 | 145.48 | 172.65 | 203.23 | 132.37 | 304.55 | 129.14 | 107.72 | 127.13 | 324.79 | 113.27 | 147.59 |
| 32 | 288.46 | 299.49 | 182.91 | 299.93 | 228.06 | 119.13 | 357.37 | 132.57 | 171.17 | 155.00 | 466.10 | 139.30 | 163.84 |
| 35 | 442.65 | 518.22 | 233.63 | 307.12 | 283.16 | 209.64 | 434.25 | 208.03 | 213.44 | 233.02 | 481.62 | 260.75 | 261.80 |
| 39 | 419.12 | 503.33 | 442.52 | 345.36 | 355.59 | 231.06 | 432.68 | 318.63 | 315.93 | 286.47 | 572.77 | 298.59 | 303.23 |
| 42 | 379.48 | 513.54 | 449.02 | 340.25 | 362.51 | 254.14 | 487.55 | 294.58 | 349.26 | 379.28 | 626.35 | 286.86 | 319.48 |
| 46 | 601.65 | 778.43 | 637.73 | 453.39 | 899.49 | 292.45 | 519.25 | 294.40 | 531.22 | 342.83 | 642.31 | 445.75 | 300.56 |
| 49 | 525.83 | 682.34 | 768.94 | 337.45 | 594.31 | 291.11 | 632.67 | 388.48 | 639.75 | 491.05 | 631.72 | 408.40 | 308.73 |
| 53 | 618.09 | 893.01 | 932.23 | 391.25 | 576.25 | 280.96 | 657.04 | 503.44 | 829.63 | 456.57 | 606.13 | 491.55 | 447.34 |
| 56 | 793.23 | 1309.26 | 1085.82 | 411.50 | 412.62 | 350.51 | 750.48 | 685.26 | 1125.76 | 612.29 | 700.58 | 616.91 | 526.88 |
| 60 | 739.94 | 1422.57 | 1373.49 | 551.40 | 804.04 | 337.95 | 707.31 | 785.59 | 1195.66 | 563.75 | 843.39 | 638.94 | 693.70 |
| 63 | 741.90 | 1467.32 | 1450.32 | 446.17 | 1078.52 | 366.30 | 677.67 | 875.47 | 1369.64 | 687.52 | 845.94 | 700.93 | 563.40 |
| 66 | 866.83 | 1933.07 | 1695.44 | 407.94 | 1033.35 | 329.52 | 871.66 | 1274.41 | 1664.40 | 748.11 | 844.09 | 755.00 | 658.18 |
| 70 | 906.91 | | 2055.70 | 454.26 | 1128.39 | 377.46 | 857.93 | 1429.06 | 1902.09 | 899.02 | 977.86 | 1151.34 | 739.87 |
| 74 | 1050.44 | | | 510.24 | 1176.17 | 431.46 | 953.57 | 1316.47 | | 1008.84 | 1082.74 | 1132.80 | 737.69 |
| 77 | 1053.86 | | | 487.54 | 1454.97 | 504.43 | 974.43 | | | 1218.43 | 1062.30 | 1010.54 | 809.49 |
| 80 | 1195.52 | | | 560.59 | 1461.63 | 527.31 | 1298.82 | | | 1316.89 | 1165.74 | 1123.06 | |
| 83 | 1211.15 | | | 591.58 | 1883.74 | 529.70 | 1530.85 | | | 1405.59 | 1132.02 | 1269.96 | |
| 88 | 1999.58 | | | 680.13 | | 489.05 | 1515.67 | | | 1704.43 | 1117.78 | | |
| 91 | | | | 676.45 | | 468.02 | | | | 1731.76 | 1139.45 | | |
| 94 | | | | 742.06 | | 547.24 | | | | | 1340.71 | | |
| 98 | | | | 848.97 | | 778.30 | | | | | 1455.98 | | |
| 102 | | | | 878.51 | | 1299.14 | | | | | 1594.26 | | |
| 105 | | | | 941.87 | | 1052.06 | | | | | 1687.50 | | |
| 109 | | | | 1033.39 | | | | | | | 1954.73 | | |
| 112 | | | | | | | | | | | | | |
| 116 | | | | | | | | | | | | | |
| 119 | | | | | | | | | | | | | |
| 123 | | | | | | | | | | | | | |
| 130 | | | | | | | | | | | | | |

TABLE 20-B

Subcutaneous tumor volumes from BALB-neuT mice treated with rHER2 vaccine, anti-CTLA4 antibody, and vehicle

| Study Day | \multicolumn{13}{c}{Animal ID} | | | | | | | | | | | | |
|---|---|---|---|---|---|---|---|---|---|---|---|---|---|
| | 014 | 015 | 016 | 017 | 018 | 019 | 020 | 021 | 022 | 023 | 024 | 025 | 026 |
| 7 | 13.95 | 22.56 | 18.32 | 15.62 | 11.30 | 23.49 | 18.30 | 31.84 | 9.95 | 19.57 | 33.34 | 16.69 | 65.80 |
| 11 | 34.59 | 36.30 | 43.55 | 30.54 | 62.36 | 47.97 | 41.74 | 74.32 | 25.47 | 36.62 | 50.96 | 29.98 | 154.10 |
| 14 | 41.04 | 48.08 | 62.76 | 42.47 | 80.69 | 57.69 | 51.46 | 96.98 | 43.76 | 43.28 | 47.76 | 38.12 | 130.87 |
| 18 | 67.89 | 80.31 | 110.34 | 86.72 | 183.17 | 111.21 | 105.15 | 128.14 | 61.38 | 44.66 | 65.32 | 95.87 | 166.62 |
| 21 | 99.74 | 87.70 | 116.80 | 63.01 | 202.53 | 131.95 | 170.80 | 144.47 | 74.50 | 81.06 | 95.35 | 96.24 | 225.45 |
| 24 | 100.18 | 104.47 | 126.72 | 123.72 | 199.19 | 174.90 | 181.60 | 189.93 | 79.15 | 104.51 | 107.09 | 138.34 | 229.64 |
| 27 | 138.24 | 115.05 | 170.33 | 106.01 | 207.56 | 164.46 | 196.44 | 218.62 | 82.23 | 134.48 | 146.91 | 157.49 | 324.63 |
| 32 | 196.50 | 135.98 | 189.16 | 163.10 | 293.78 | 208.00 | 248.90 | 280.19 | 114.59 | 185.61 | 191.56 | 183.81 | 337.93 |
| 35 | 300.50 | 169.60 | 305.77 | 181.56 | 291.73 | 245.74 | 290.40 | 320.25 | 111.99 | 184.88 | 184.57 | 176.67 | 380.74 |
| 39 | 348.00 | 183.57 | 256.74 | 228.53 | 263.61 | 223.27 | 360.65 | 295.43 | 100.52 | 194.95 | 192.31 | 190.70 | 367.56 |
| 42 | 390.91 | 204.84 | 371.25 | 210.94 | 300.94 | 254.67 | 476.59 | 322.83 | 133.90 | 191.45 | 219.12 | 210.83 | 422.25 |
| 46 | 421.06 | 239.56 | 459.18 | 283.40 | 311.32 | 342.97 | 627.22 | 297.13 | 153.38 | 228.26 | 252.46 | 338.26 | 514.20 |
| 49 | 570.42 | 242.71 | 444.89 | 285.69 | 254.99 | 300.41 | 686.74 | 284.73 | 156.78 | 285.33 | 230.83 | 351.06 | 418.01 |
| 53 | 564.06 | 227.19 | 491.62 | 296.54 | 257.35 | 357.26 | 800.42 | 310.23 | 193.53 | 335.75 | 222.12 | 356.37 | 601.40 |
| 56 | 733.33 | 228.06 | 627.11 | 472.36 | 259.93 | 418.71 | 1013.00 | 302.14 | 219.62 | 383.69 | 241.56 | 449.13 | 609.87 |

TABLE 20-B-continued

Subcutaneous tumor volumes from BALB-neuT mice treated with rHER2 vaccine, anti-CTLA4 antibody, and vehicle

| Study Day | Animal ID | | | | | | | | | | | | |
|---|---|---|---|---|---|---|---|---|---|---|---|---|---|
| | 014 | 015 | 016 | 017 | 018 | 019 | 020 | 021 | 022 | 023 | 024 | 025 | 026 |
| 60 | 897.14 | 267.39 | 607.90 | 517.19 | 312.72 | 420.79 | 1308.77 | 320.64 | 239.16 | 515.83 | 299.24 | 489.26 | 749.84 |
| 63 | 1057.26 | 268.83 | 660.87 | 445.35 | 316.86 | 483.64 | 1291.15 | 287.14 | 232.50 | 662.34 | 282.33 | 535.65 | 896.13 |
| 66 | 1300.92 | 322.12 | 896.63 | 481.50 | 348.28 | 488.58 | 1429.48 | 306.39 | 233.64 | 847.54 | 266.11 | 657.11 | 1007.19 |
| 70 | 1405.80 | 390.93 | 904.47 | 478.25 | 348.24 | 601.13 | 1420.89 | 382.32 | 315.81 | 804.92 | 268.72 | 760.97 | 977.72 |
| 74 | 1663.99 | 530.06 | 1051.68 | 520.03 | 404.21 | 658.56 | | 367.96 | 440.99 | 955.16 | 344.38 | 794.70 | 1421.67 |
| 77 | 1926.01 | 573.89 | 1219.67 | 601.49 | 470.28 | 749.73 | | 412.46 | 464.76 | 1194.80 | 329.63 | 901.75 | 1329.51 |
| 80 | | 739.80 | 1349.40 | 718.31 | 394.95 | 752.93 | | 420.98 | 495.99 | 1263.58 | 373.06 | 946.52 | 1232.01 |
| 83 | | 877.75 | 1653.19 | 910.62 | 466.02 | 820.70 | | 448.59 | 566.16 | 1553.21 | 438.83 | 942.35 | 1298.75 |
| 88 | | 954.88 | | 1265.55 | 846.03 | 937.01 | | 414.87 | 788.55 | 1916.96 | 495.65 | 1301.75 | 2002.26 |
| 91 | | 961.42 | | 1174.80 | 866.62 | 954.49 | | 491.20 | 846.32 | | 581.42 | 1283.15 | |
| 94 | | 1053.93 | | 1399.91 | 1002.14 | 1078.80 | | 408.20 | 933.39 | | 495.83 | 1539.79 | |
| 98 | | 1477.19 | | 1785.93 | 1094.65 | 1355.24 | | 480.75 | 1020.62 | | 695.49 | | |
| 102 | | 2005.53 | | 2455.90 | 1132.60 | 1506.85 | | 617.31 | 1196.80 | | 1049.34 | | |
| 105 | | | | | 1137.28 | 1646.70 | | 558.65 | 1519.06 | | 973.46 | | |
| 109 | | | | | 1629.53 | 2411.79 | | 567.21 | 1927.56 | | 1376.50 | | |
| 112 | | | | | 1610.74 | | | 659.07 | | | 1331.93 | | |
| 116 | | | | | 1903.32 | | | 736.53 | | | 2020.97 | | |
| 119 | | | | | | | | 843.09 | | | | | |
| 123 | | | | | | | | 812.58 | | | | | |
| 130 | | | | | | | | | | | | | |

TABLE 20-C

Subcutaneous tumor volumes from BALB-neuT mice treated with rHER2 vaccine, isotype monoclonal antibody, and IDO1 inhibitor

| Study Day | Animal ID | | | | | | | | | | | | |
|---|---|---|---|---|---|---|---|---|---|---|---|---|---|
| | 027 | 028 | 029 | 030 | 031 | 032 | 033 | 034 | 035 | 036 | 037 | 038 | 039 |
| 7 | 22.57 | 18.54 | 24.25 | 23.74 | 62.87 | 47.26 | 26.06 | 19.89 | 10.02 | 28.07 | 9.21 | 19.87 | 26.44 |
| 11 | 27.87 | 26.90 | 25.69 | 35.75 | 109.91 | 55.24 | 54.27 | 30.68 | 16.48 | 75.34 | 18.47 | 66.24 | 42.82 |
| 14 | 32.46 | 29.47 | 31.95 | 40.32 | 144.26 | 47.57 | 54.29 | 58.07 | 27.84 | 92.84 | 31.83 | 58.59 | 71.17 |
| 18 | 37.10 | 57.13 | 44.48 | 94.60 | 278.87 | 90.96 | 63.91 | 74.80 | 44.97 | 129.98 | 43.36 | 94.67 | 123.44 |
| 21 | 50.62 | 96.30 | 64.33 | 124.60 | 392.48 | 143.92 | 101.50 | 73.61 | 71.45 | 153.08 | 63.58 | 123.83 | 111.42 |
| 24 | 55.76 | 109.72 | 75.91 | 174.47 | 438.38 | 161.19 | 115.11 | 79.60 | 109.91 | 174.26 | 64.08 | 93.15 | 128.18 |
| 27 | 55.49 | 118.93 | 95.32 | 178.96 | 542.65 | 202.58 | 154.54 | 105.80 | 127.26 | 195.71 | 79.97 | 106.00 | 144.12 |
| 32 | 113.02 | 157.60 | 160.49 | 235.16 | 717.70 | 252.81 | 233.30 | 127.84 | 188.23 | 260.21 | 93.05 | 177.97 | 137.99 |
| 35 | 92.45 | 185.58 | 176.42 | 257.51 | 786.70 | 368.98 | 292.35 | 142.96 | 309.08 | 262.68 | 119.74 | 194.95 | 127.66 |
| 39 | 128.29 | 276.68 | 279.74 | 333.07 | 937.96 | 457.17 | 284.18 | 216.33 | 363.62 | 340.70 | 113.68 | 234.56 | 162.13 |
| 42 | 200.60 | 308.88 | 309.27 | 411.98 | 1141.65 | 546.41 | 378.60 | 193.55 | 445.98 | 279.28 | 139.47 | 238.77 | 171.63 |
| 46 | 245.58 | 362.11 | 390.14 | 554.66 | 1129.43 | 699.15 | 522.13 | 211.14 | 579.92 | 446.04 | 163.31 | 271.10 | 171.35 |
| 49 | 185.53 | 407.07 | 389.34 | 678.29 | 1357.08 | 663.42 | 435.48 | 199.16 | 548.74 | 496.65 | 256.92 | 327.15 | 158.18 |
| 53 | 234.92 | 572.92 | 472.69 | 760.44 | 1657.89 | 764.79 | 576.68 | 195.14 | 749.50 | 403.22 | 271.69 | 340.39 | 179.89 |
| 56 | 315.08 | 654.90 | 527.02 | 970.81 | 1830.37 | 918.21 | 811.53 | 215.44 | 1080.73 | 535.72 | 398.94 | 394.64 | 240.12 |
| 60 | 358.46 | 802.56 | 733.00 | 1126.99 | 2337.11 | 943.99 | 973.45 | 235.27 | 1169.89 | 727.24 | 431.20 | 437.25 | 219.66 |
| 63 | 329.23 | 988.22 | 686.07 | 1326.18 | | 1114.22 | 1180.40 | 205.89 | 1491.79 | 749.53 | 706.03 | 443.52 | 228.26 |
| 66 | 419.20 | 1116.22 | 720.64 | 1550.51 | | 1367.74 | 2093.28 | 183.53 | 1747.57 | 1500.11 | 948.51 | 536.57 | 249.72 |
| 70 | 474.17 | 1374.23 | 967.99 | 1760.87 | | | | 227.05 | | 1478.26 | 1065.41 | 623.91 | 248.73 |
| 74 | 624.62 | 1772.89 | 1197.73 | 2006.03 | | | | 233.91 | | 1494.91 | 1316.37 | 622.88 | 374.49 |
| 77 | 647.51 | 1989.96 | 1262.15 | | | | | 253.71 | | 1990.94 | 1897.98 | 714.20 | 486.35 |
| 80 | | | 1539.37 | | | | | 247.06 | | | | 746.30 | 361.49 |
| 83 | | | 2002.66 | | | | | 221.28 | | | | 947.06 | 470.06 |
| 88 | | | | | | | | 302.35 | | | | 1049.34 | 607.71 |
| 91 | | | | | | | | 283.62 | | | | 1094.29 | 584.53 |
| 94 | | | | | | | | 240.95 | | | | 1223.56 | 707.49 |
| 98 | | | | | | | | 267.69 | | | | 1157.88 | 819.76 |
| 102 | | | | | | | | 332.05 | | | | 1588.42 | 1166.09 |
| 105 | | | | | | | | | | | | | |
| 109 | | | | | | | | | | | | | |
| 112 | | | | | | | | | | | | | |
| 116 | | | | | | | | | | | | | |
| 119 | | | | | | | | | | | | | |
| 123 | | | | | | | | | | | | | |
| 130 | | | | | | | | | | | | | |

TABLE 20-D

Subcutaneous tumor volumes from BALB-neuT mice treated with rHER2 vaccine, anti-CTLA4 antibody, and IDO1 inhibitor

| Study Day | \multicolumn{13}{c}{Animal ID} |
|---|---|---|---|---|---|---|---|---|---|---|---|---|---|
|  | 040 | 041 | 042 | 043 | 044 | 045 | 046 | 047 | 048 | 049 | 050 | 051 | 052 |
| 7 | 54.10 | 39.35 | 23.64 | 21.18 | 12.84 | 21.67 | 20.25 | 19.96 | 25.33 | 36.98 | 36.19 | 31.76 | 23.13 |
| 11 | 44.01 | 62.51 | 25.95 | 22.00 | 20.61 | 29.61 | 22.93 | 31.30 | 54.95 | 60.31 | 40.28 | 64.26 | 35.48 |
| 14 | 82.71 | 61.84 | 44.03 | 41.17 | 27.61 | 39.84 | 31.52 | 50.27 | 53.59 | 167.13 | 39.13 | 71.77 | 46.37 |
| 18 | 109.42 | 104.01 | 70.45 | 47.24 | 39.37 | 43.45 | 46.45 | 64.50 | 96.05 | 118.82 | 86.60 | 117.11 | 52.67 |
| 21 | 156.97 | 122.98 | 122.03 | 88.69 | 39.10 | 79.80 | 74.00 | 59.76 | 126.21 | 150.23 | 67.16 | 106.50 | 64.01 |
| 24 | 161.80 | 181.51 | 136.55 | 66.17 | 83.81 | 80.21 | 101.01 | 78.26 | 212.63 | 154.56 | 83.75 | 155.85 | 83.60 |
| 27 | 193.79 | 191.62 | 257.40 | 93.98 | 102.01 | 129.31 | 84.05 | 104.26 | 160.51 | 139.11 | 77.42 | 167.41 | 92.72 |
| 32 | 243.54 | 263.07 | 273.35 | 158.04 | 101.16 | 150.00 | 98.57 | 156.07 | 255.04 | 162.11 | 101.56 | 203.30 | 114.82 |
| 35 | 312.75 | 361.78 | 504.87 | 164.62 | 144.05 | 120.50 | 122.05 | 142.97 | 316.54 | 172.90 | 114.17 | 218.18 | 132.22 |
| 39 | 396.82 | 323.31 | 582.32 | 242.63 | 157.89 | 232.03 | 95.33 | 154.30 | 425.09 | 257.83 | 149.53 | 267.35 | 168.35 |
| 42 | 413.28 | 367.59 | 663.21 | 254.92 | 250.62 | 281.01 | 169.40 | 159.04 | 427.33 | 259.24 | 151.88 | 259.86 | 147.14 |
| 46 | 442.03 | 400.06 | 833.78 | 245.54 | 247.14 | 265.42 | 196.92 | 188.31 | 582.82 | 304.99 | 146.35 | 227.25 | 171.42 |
| 49 | 499.68 | 458.65 | 692.49 | 269.68 | 303.80 | 298.85 | 239.11 | 199.54 | 582.63 | 363.70 | 147.05 | 184.65 | 192.15 |
| 53 | 602.85 | 388.55 | 832.63 | 319.74 | 338.88 | 350.68 | 147.19 | 189.14 | 683.19 | 425.27 | 141.44 | 180.96 | 175.06 |
| 56 | 678.49 | 583.14 | 1172.60 | 313.88 | 375.36 | 490.44 | 121.54 | 250.75 | 1015.63 | 421.92 | 193.75 | 223.80 | 167.34 |
| 60 | 716.23 | 566.05 | 1993.58 | 297.92 | 405.37 | 488.16 | 168.02 | 276.09 | 1016.18 | 568.77 | 192.25 | 253.13 | 176.65 |
| 63 | 763.88 | 694.35 |  | 360.21 | 477.42 | 576.05 | 214.59 | 394.42 | 1118.06 | 623.54 | 160.79 | 259.78 | 142.51 |
| 66 | 903.52 | 896.37 |  | 398.70 | 639.62 | 743.61 | 272.91 | 395.65 | 1444.51 |  | 200.21 | 264.16 | 219.92 |
| 70 | 1067.20 | 981.05 |  | 432.21 | 590.19 | 768.14 | 239.03 | 427.52 | 1594.41 |  | 193.97 | 320.82 | 183.68 |
| 74 | 991.59 | 1190.31 |  | 573.68 | 743.70 | 903.33 | 222.29 | 428.53 | 1656.59 |  | 188.48 | 308.71 | 167.55 |
| 77 | 1018.46 | 1567.97 |  | 556.19 | 716.08 | 967.81 | 309.27 | 484.64 | 1917.82 |  | 194.87 | 253.57 | 162.01 |
| 80 | 1195.74 | 1390.97 |  | 574.12 |  | 1102.62 | 277.63 | 627.19 |  |  | 261.80 | 367.28 | 201.87 |
| 83 | 1331.93 | 1884.11 |  | 579.14 |  | 1695.16 | 256.90 | 690.39 |  |  | 292.88 | 325.23 | 199.87 |
| 88 |  |  |  | 772.39 |  | 1995.92 | 276.57 | 645.27 |  |  | 363.61 | 379.12 | 210.81 |
| 91 |  |  |  | 751.29 |  |  | 320.68 | 626.20 |  |  | 350.28 | 428.39 | 224.19 |
| 94 |  |  |  | 1288.49 |  |  | 335.59 | 627.27 |  |  | 402.96 | 462.28 | 238.84 |
| 98 |  |  |  | 1164.73 |  |  | 337.65 | 830.60 |  |  | 438.33 | 581.69 | 298.47 |
| 102 |  |  |  | 1324.12 |  |  | 409.66 | 1014.27 |  |  | 505.42 | 602.90 | 427.80 |
| 105 |  |  |  | 1202.44 |  |  | 467.05 | 1140.43 |  |  | 521.30 | 712.86 | 411.28 |
| 109 |  |  |  | 2079.90 |  |  | 483.78 | 1218.84 |  |  | 757.14 | 707.01 | 544.77 |
| 112 |  |  |  |  |  |  | 579.36 | 1346.57 |  |  | 607.66 | 873.67 | 598.32 |
| 116 |  |  |  |  |  |  | 814.25 | 1570.94 |  |  | 721.33 | 1148.33 | 658.27 |
| 119 |  |  |  |  |  |  | 782.56 | 1999.79 |  |  | 784.41 | 1318.46 | 601.06 |
| 123 |  |  |  |  |  |  | 661.23 |  |  |  | 664.85 | 1320.43 | 626.48 |
| 130 |  |  |  |  |  |  | 1027.75 |  |  |  | 883.59 | 1979.35 | 671.05 |

TABLE 20-E

Subcutaneous tumor volumes from BALB-neuT mice treated with control vaccine, isotype monoclonal antibody, and vehicle

| Study Day | \multicolumn{13}{c}{Animal ID} |
|---|---|---|---|---|---|---|---|---|---|---|---|---|---|
|  | 053 | 054 | 055 | 056 | 057 | 058 | 059 | 060 | 061 | 062 | 063 | 064 | 065 |
| 7 | 15.08 | 18.70 | 72.45 | 17.86 | 31.00 | 18.49 | 33.40 | 29.51 | 67.11 | 24.58 | 10.81 | 23.92 | 19.49 |
| 11 | 58.60 | 54.25 | 123.35 | 30.28 | 58.33 | 33.39 | 50.68 | 123.50 | 101.88 | 40.82 | 37.88 | 46.17 | 54.79 |
| 14 | 66.13 | 57.25 | 141.53 | 59.92 | 51.27 | 38.54 | 69.03 | 149.25 | 115.84 | 59.04 | 60.55 | 47.41 | 60.04 |
| 18 | 100.35 | 127.83 | 169.74 | 108.08 | 98.62 | 74.59 | 93.79 | 221.58 | 216.32 | 66.67 | 150.77 | 88.44 | 96.81 |
| 21 | 104.51 | 155.77 | 207.70 | 135.72 | 129.89 | 107.63 | 104.90 | 323.75 | 280.31 | 81.26 | 154.01 | 106.39 | 153.56 |
| 24 | 164.46 | 178.17 | 273.86 | 194.10 | 166.70 | 130.99 | 108.08 | 428.86 | 388.16 | 121.42 | 204.26 | 240.02 | 179.89 |
| 27 | 173.12 | 266.11 | 433.12 | 274.20 | 221.81 | 175.65 | 208.91 | 501.03 | 393.66 | 143.97 | 228.35 | 196.57 | 262.10 |
| 32 | 240.12 | 374.31 | 702.18 | 390.43 | 326.57 | 241.87 | 243.68 | 603.91 | 567.21 | 223.65 | 309.24 | 290.32 | 450.62 |
| 35 | 372.09 | 483.08 | 708.07 | 543.61 | 542.74 | 318.46 | 343.70 | 890.20 | 705.62 | 251.46 | 424.33 | 286.92 | 397.85 |
| 39 | 455.22 | 657.38 | 939.28 | 588.96 | 567.05 | 467.47 | 473.88 | 956.11 | 993.67 | 395.46 | 526.97 | 308.71 | 620.57 |
| 42 | 585.12 | 765.03 | 1120.45 | 666.99 | 688.37 | 555.97 | 607.03 | 951.75 | 1173.89 | 463.83 | 672.59 | 469.69 | 773.08 |
| 46 | 791.60 | 1105.75 | 1323.69 | 1128.15 | 1155.17 | 702.22 | 789.24 | 1616.22 | 1451.45 | 639.83 | 934.86 | 479.45 | 927.62 |
| 49 | 1097.81 | 1189.35 | 2028.49 | 1236.32 | 1244.71 | 1014.51 | 1016.09 | 1914.25 | 2034.67 | 749.54 | 1173.78 | 707.56 | 1212.93 |
| 53 | 1363.43 | 1631.61 |  | 1657.80 | 1743.67 | 1081.25 | 1316.46 |  |  | 1274.45 | 1667.48 | 790.81 | 1474.56 |
| 56 | 1483.62 | 1904.26 |  | 1771.67 | 1688.79 | 1183.68 | 1311.02 |  |  | 1098.40 | 1953.44 | 960.80 | 1659.31 |
| 60 | 1901.83 |  |  | 2068.50 | 2061.22 | 1286.21 | 2034.92 |  |  | 1705.47 |  | 1061.59 | 1779.08 |
| 63 |  |  |  |  |  | 1517.04 |  |  |  | 1642.50 |  | 1308.21 |  |
| 66 |  |  |  |  |  | 1902.74 |  |  |  | 1940.74 |  | 1450.05 |  |
| 70 |  |  |  |  |  |  |  |  |  |  |  |  |  |
| 74 |  |  |  |  |  |  |  |  |  |  |  |  |  |
| 77 |  |  |  |  |  |  |  |  |  |  |  |  |  |
| 80 |  |  |  |  |  |  |  |  |  |  |  |  |  |
| 83 |  |  |  |  |  |  |  |  |  |  |  |  |  |
| 88 |  |  |  |  |  |  |  |  |  |  |  |  |  |

TABLE 20-E-continued

Subcutaneous tumor volumes from BALB-neuT mice treated with control vaccine, isotype monoclonal antibody, and vehicle

| Study Day | 053 | 054 | 055 | 056 | 057 | 058 | 059 | 060 | 061 | 062 | 063 | 064 | 065 |
|---|---|---|---|---|---|---|---|---|---|---|---|---|---|
| 91 | | | | | | | | | | | | | |
| 94 | | | | | | | | | | | | | |
| 98 | | | | | | | | | | | | | |
| 102 | | | | | | | | | | | | | |
| 105 | | | | | | | | | | | | | |
| 109 | | | | | | | | | | | | | |
| 112 | | | | | | | | | | | | | |
| 116 | | | | | | | | | | | | | |
| 119 | | | | | | | | | | | | | |
| 123 | | | | | | | | | | | | | |
| 130 | | | | | | | | | | | | | |

TABLE 20-F

Subcutaneous tumor volumes from BALB-neuT mice treated with control vaccine, anti-CTLA4 antibody, and vehicle

| Study Day | 066 | 067 | 068 | 069 | 070 | 071 | 072 | 073 | 074 | 075 | 076 | 077 | 078 |
|---|---|---|---|---|---|---|---|---|---|---|---|---|---|
| 7 | 31.57 | 16.81 | 19.84 | 26.53 | 31.95 | 45.30 | 30.22 | 15.04 | 28.27 | 24.27 | 18.27 | 23.86 | 26.78 |
| 11 | 65.01 | 42.45 | 77.71 | 42.97 | 36.94 | 69.07 | 53.78 | 18.79 | 28.90 | 60.85 | 35.20 | 33.73 | 35.30 |
| 14 | 67.75 | 52.64 | 58.52 | 59.81 | 51.64 | 133.54 | 50.06 | 18.81 | 54.38 | 56.90 | 38.19 | 43.61 | 42.69 |
| 18 | 107.43 | 80.43 | 24.77 | 75.41 | 120.27 | 138.58 | 113.91 | 32.23 | 72.21 | 86.65 | 63.99 | 61.86 | 79.41 |
| 21 | 108.33 | 122.66 | 58.44 | 99.93 | 115.49 | 169.67 | 108.74 | 33.66 | 68.85 | 81.49 | 66.19 | 88.88 | 92.80 |
| 24 | 135.87 | 142.73 | 205.72 | 138.58 | 195.34 | 245.58 | 199.84 | 38.82 | 78.26 | 111.41 | 115.74 | 81.24 | 114.15 |
| 27 | 202.52 | 136.92 | 233.44 | 218.55 | 257.60 | 249.39 | 215.05 | 76.57 | 102.07 | 177.24 | 146.52 | 118.63 | 158.62 |
| 32 | 265.16 | 246.28 | 392.99 | 523.97 | 289.01 | 453.52 | 389.26 | 119.16 | 173.75 | 215.29 | 168.01 | 195.78 | 237.85 |
| 35 | 268.11 | 307.75 | 523.86 | 498.69 | 338.58 | 411.31 | 536.87 | 158.61 | 254.89 | 319.28 | 282.80 | 305.00 | 330.57 |
| 39 | 409.74 | 488.72 | 621.93 | 678.35 | 518.57 | 665.59 | 568.49 | 234.62 | 508.87 | 394.05 | 315.21 | 347.86 | 518.94 |
| 42 | 497.76 | 579.50 | 613.71 | 650.46 | 604.07 | 786.51 | 635.44 | 267.01 | 515.71 | 498.47 | 474.74 | 425.11 | 661.10 |
| 46 | 568.07 | 779.30 | 807.17 | 846.95 | 842.44 | 866.45 | 856.31 | 300.02 | 602.44 | 740.77 | 583.16 | 507.16 | 874.70 |
| 49 | 870.94 | 998.56 | 1070.92 | 1642.07 | 1027.26 | 1066.57 | 957.73 | 354.92 | 833.74 | 770.76 | 792.40 | 839.43 | 1103.46 |
| 53 | 924.06 | 1547.25 | 1372.06 | 2026.49 | 1295.16 | 1430.84 | 1522.16 | 498.99 | 1122.50 | 971.82 | 967.85 | 1050.27 | 1374.42 |
| 56 | 1119.84 | 1615.70 | 1971.09 | | 1602.07 | | 1567.94 | 598.49 | 1087.10 | 1101.63 | 1179.51 | 1148.98 | 1930.34 |
| 60 | 1734.81 | 2275.56 | | | 1953.31 | | 2130.99 | 821.52 | 1460.04 | 1371.70 | 1568.95 | 1543.35 | |
| 63 | 2187.87 | | | | | | | 881.14 | | 1613.94 | 1944.88 | 1672.95 | |
| 66 | | | | | | | | 1097.85 | | 2080.38 | | 2213.55 | |
| 70 | | | | | | | | 1476.50 | | | | | |
| 74 | | | | | | | | 1925.13 | | | | | |
| 77 | | | | | | | | | | | | | |
| 80 | | | | | | | | | | | | | |
| 83 | | | | | | | | | | | | | |
| 88 | | | | | | | | | | | | | |
| 91 | | | | | | | | | | | | | |
| 94 | | | | | | | | | | | | | |
| 98 | | | | | | | | | | | | | |
| 102 | | | | | | | | | | | | | |
| 105 | | | | | | | | | | | | | |
| 109 | | | | | | | | | | | | | |
| 112 | | | | | | | | | | | | | |
| 116 | | | | | | | | | | | | | |
| 119 | | | | | | | | | | | | | |
| 123 | | | | | | | | | | | | | |
| 130 | | | | | | | | | | | | | |

TABLE 20-G

Subcutaneous tumor volumes from BALB-neuT mice treated with control vaccine, isotype control monoclonal antibody, and IDO1 inhibitor

| Study Day | _____ Animal ID _____ | | | | | | | | | | | | |
|---|---|---|---|---|---|---|---|---|---|---|---|---|
| | 079 | 080 | 081 | 082 | 083 | 084 | 085 | 086 | 087 | 088 | 089 | 090 | 091 |
| 7 | 27.80 | 36.46 | 21.11 | 15.78 | 34.61 | 12.22 | 14.78 | 20.72 | 28.62 | 21.87 | 32.40 | 18.45 | 21.99 |
| 11 | 50.27 | 46.02 | 29.32 | 42.34 | 66.59 | 21.18 | 19.13 | 51.22 | 33.59 | 28.63 | 52.20 | 24.65 | 50.36 |
| 14 | 66.16 | 39.75 | 31.22 | 43.83 | 99.08 | 27.42 | 36.76 | 53.21 | 62.59 | 35.08 | 54.92 | 44.31 | 85.94 |
| 18 | 87.17 | 73.84 | 62.25 | 84.25 | 115.90 | 47.77 | 40.28 | 81.38 | 130.43 | 43.33 | 77.07 | 67.44 | 136.82 |
| 21 | 91.03 | 75.81 | 78.22 | 89.04 | 182.85 | 58.23 | 54.88 | 135.90 | 127.97 | 64.93 | 113.76 | 113.10 | 163.91 |
| 24 | 161.46 | 100.08 | 101.79 | 140.26 | 284.27 | 88.35 | 55.22 | 110.30 | 155.81 | 92.35 | 169.45 | 127.09 | 198.49 |
| 27 | 163.11 | 125.82 | 123.19 | 186.49 | 361.01 | 112.48 | 80.13 | 147.33 | 241.15 | 110.42 | 171.37 | 129.44 | 240.05 |
| 32 | 252.04 | 251.57 | 194.14 | 275.98 | 541.91 | 153.38 | 110.90 | 184.76 | 321.37 | 173.28 | 301.94 | 202.21 | 337.79 |
| 35 | 324.53 | 262.56 | 246.60 | 364.82 | 598.92 | 209.97 | 141.15 | 244.33 | 521.30 | 260.28 | 306.58 | 377.96 | 401.70 |
| 39 | 414.72 | 434.13 | 389.39 | 471.60 | 671.98 | 338.06 | 192.15 | 328.32 | 572.30 | 343.13 | 512.15 | 430.30 | 596.09 |
| 42 | 603.00 | 551.64 | 463.99 | 601.50 | 820.44 | 340.52 | 268.88 | 441.62 | 676.89 | 408.33 | 574.86 | 574.25 | 680.54 |
| 46 | 660.63 | 696.77 | 782.22 | 933.81 | 997.91 | 431.11 | 345.63 | 682.81 | 1060.91 | 604.23 | 818.67 | 719.57 | 909.66 |
| 49 | 685.30 | 917.68 | 1138.52 | 1124.52 | 1219.32 | 609.28 | 470.15 | 807.07 | 1164.50 | 629.55 | 940.30 | 942.51 | 1045.76 |
| 53 | 864.42 | 1073.56 | 1288.73 | 1449.44 | 1275.84 | 735.98 | 547.89 | 1167.81 | 1618.54 | 792.50 | 1373.25 | 1139.13 | 1614.31 |
| 56 | 943.28 | 1323.69 | 1631.81 | 1937.45 | 2064.17 | 952.77 | 893.91 | 1714.64 | 1754.98 | 1128.21 | 1630.88 | 1431.28 | 1471.68 |
| 60 | 1384.35 | 1653.35 | 1673.55 | | | 1107.86 | 928.10 | 1923.35 | 1918.84 | 1450.47 | | 1946.29 | |
| 63 | 1600.66 | 2089.13 | 1682.01 | | | 1426.67 | 938.92 | | | 1652.48 | | | |
| 66 | 1776.61 | | 1982.89 | | | 1416.50 | 1198.20 | | | 1985.40 | | | |
| 70 | 2186.37 | | | | | 1974.53 | 1804.46 | | | | | | |
| 74 | | | | | | | 1816.96 | | | | | | |
| 77 | | | | | | | 2039.55 | | | | | | |
| 80 | | | | | | | | | | | | | |
| 83 | | | | | | | | | | | | | |
| 88 | | | | | | | | | | | | | |
| 91 | | | | | | | | | | | | | |
| 94 | | | | | | | | | | | | | |
| 98 | | | | | | | | | | | | | |
| 102 | | | | | | | | | | | | | |
| 105 | | | | | | | | | | | | | |
| 109 | | | | | | | | | | | | | |
| 112 | | | | | | | | | | | | | |
| 116 | | | | | | | | | | | | | |
| 119 | | | | | | | | | | | | | |
| 123 | | | | | | | | | | | | | |
| 130 | | | | | | | | | | | | | |

TABLE 20-H

Subcutaneous tumor volumes from BALB-neuT mice treated with control vaccine, anti-CTLA4 antibody, and IDO1 inhibitor

| Study Day | _____ Animal ID _____ | | | | | | | | | | | | |
|---|---|---|---|---|---|---|---|---|---|---|---|---|
| | 092 | 093 | 094 | 095 | 096 | 097 | 098 | 099 | 100 | 101 | 102 | 103 | 104 |
| 7 | 23.50 | 79.61 | 37.58 | 33.69 | 19.24 | 51.28 | 54.39 | 19.99 | 17.96 | 31.15 | 41.65 | 32.98 | 14.52 |
| 11 | 45.95 | 175.07 | 60.28 | 42.51 | 34.51 | 127.99 | 62.57 | 55.07 | 51.65 | 88.69 | 90.89 | 44.64 | 17.86 |
| 14 | 63.89 | 163.67 | 77.18 | 67.42 | 37.76 | 116.30 | 79.39 | 64.35 | 48.63 | 82.68 | 82.10 | 61.33 | 31.37 |
| 18 | 97.30 | 243.40 | 197.71 | 102.33 | 112.32 | 153.27 | 92.24 | 113.19 | 68.81 | 140.37 | 217.09 | 87.60 | 42.00 |
| 21 | 160.23 | 249.28 | 155.64 | 109.24 | 159.77 | 171.07 | 124.87 | 141.01 | 104.12 | 184.89 | 223.66 | 124.77 | 52.28 |
| 24 | 214.44 | 358.20 | 178.52 | 146.05 | 155.75 | 189.29 | 160.00 | 185.05 | 133.44 | 222.78 | 308.93 | 149.93 | 65.39 |
| 27 | 240.41 | 415.24 | 198.00 | 191.28 | 267.39 | 298.20 | 231.41 | 157.93 | 191.15 | 238.17 | 416.37 | 211.67 | 87.13 |
| 32 | 513.57 | 601.62 | 385.73 | 344.44 | 444.06 | 376.94 | 324.54 | 244.96 | 328.38 | 365.22 | 635.31 | 358.92 | 99.41 |
| 35 | 616.99 | 692.22 | 389.96 | 455.32 | 417.99 | 484.35 | 441.24 | 264.56 | 333.93 | 437.71 | 813.28 | 385.04 | 177.23 |
| 39 | 715.16 | 1023.24 | 500.83 | 638.78 | 601.10 | 775.30 | 639.05 | 308.73 | 509.92 | 543.97 | 905.65 | 530.66 | 235.25 |
| 42 | 717.28 | 1165.74 | 503.20 | 815.34 | 596.80 | 798.96 | 795.51 | 361.27 | 438.96 | 638.64 | 1106.64 | 673.19 | 239.49 |
| 46 | 1123.80 | 1329.85 | 768.11 | 1034.27 | 895.57 | 1266.07 | 1001.88 | 500.68 | 781.21 | 813.68 | 1270.88 | 827.87 | 352.48 |
| 49 | 1401.34 | 1734.62 | 1016.27 | 1222.00 | 945.71 | 1346.31 | 1044.92 | 712.92 | 1214.73 | 954.08 | 1780.32 | 843.85 | 571.40 |
| 53 | 1589.06 | 2021.70 | 1176.32 | 1559.52 | 1296.01 | 1620.80 | 1558.21 | 958.70 | 1154.16 | | 2036.34 | 931.60 | 673.63 |
| 56 | 2311.25 | | 1343.46 | 1818.39 | 1465.17 | 2067.77 | 1760.94 | 1195.69 | 1541.24 | | | 1296.52 | 901.88 |
| 60 | | | 1631.83 | 2068.78 | 1667.99 | | 1626.18 | 1630.40 | 1783.77 | | | 1468.55 | 1185.11 |
| 63 | | | 1969.65 | | 1571.44 | | | 1651.73 | 2028.86 | | | 1737.96 | 1296.69 |
| 66 | | | | | | | | 1927.56 | | | | | 1929.80 |
| 70 | | | | | | | | | | | | | |
| 74 | | | | | | | | | | | | | |
| 77 | | | | | | | | | | | | | |
| 80 | | | | | | | | | | | | | |
| 83 | | | | | | | | | | | | | |
| 88 | | | | | | | | | | | | | |

TABLE 20-H-continued

Subcutaneous tumor volumes from BALB-neuT mice treated with control vaccine, anti-CTLA4 antibody, and IDO1 inhibitor

| Study | | | | | | Animal ID | | | | | | | |
|---|---|---|---|---|---|---|---|---|---|---|---|---|---|
| Day | 092 | 093 | 094 | 095 | 096 | 097 | 098 | 099 | 100 | 101 | 102 | 103 | 104 |
| 91 | | | | | | | | | | | | | |
| 94 | | | | | | | | | | | | | |
| 98 | | | | | | | | | | | | | |
| 102 | | | | | | | | | | | | | |
| 105 | | | | | | | | | | | | | |
| 109 | | | | | | | | | | | | | |
| 112 | | | | | | | | | | | | | |
| 116 | | | | | | | | | | | | | |
| 119 | | | | | | | | | | | | | |
| 123 | | | | | | | | | | | | | |
| 130 | | | | | | | | | | | | | |

Primers Used for Construction of Plasmids Described in the Examples

| Primer | SEQUENCE (5' TO 3') | Strand | SEQ ID NO |
|---|---|---|---|
| EMCV_cMSLN_F-33 | GAGACAAACCCTGGCCCCCTGGCTGGCGAGACAGGACAGGAAG | Sense | 75 |
| EMCV_Muc1_R-35 | GTTGAAGATTCTGCCGGATCCCAGGTTGGCGGAGGCAGCGGCCACG | Antisense | 76 |
| EMCV2A_F-34 | GCTACTTCGCCGACCTGCTGATCCACGACATCGAGACAAACCCTGGC | Sense | 77 |
| EMCV2A_R-36 | GGTCGGCGAAGTAGCCGGCGTAGTGGGCGTTGAAGATTCTGCCGGAT | Antisense | 78 |
| f MSLN 1028-1051 | TTCTGAAGATGAGCCCCGAGGACA | Sense | 79 |
| f Muc 960-983 | CGGCGTCTCATTCTTCTTTCTGTC | Sense | 80 |
| f pmed Nhe cMSLN | ACCCTGTGACGAACATGGCTAGCCTGGCTGGCGAGACAGGACAGGA | Sense | 81 |
| f pmed Nhe cytMuc | ACCCTGTGACGAACATGGCTAGCACAGGCTCTGGCCACGCCAG | Sense | 82 |
| f pmed Nhe Muc | ACCCTGTGACGAACATGGCTAGCACCCCTGGAACCCAGAGCC | Sense | 83 |
| f pmed Nhe Ter240 | ACCCTGTGACGAACATGGCTAGCGGAGCTGCCCCGGAGCCGG | Sense | 84 |
| f tert 1584-1607 | TCTCACCGACCTCCAGCCTTACAT | Sense | 85 |
| f tert ink cMSLN | ACGGAGGCTCCGGCGGACTGGCTGGCGAGACAGGACA | Sense | 86 |
| f tg link Ter240 | TGGGAGGCTCCGGCGGAGGAGCTGCCCCGGAGCCGG | Sense | 87 |
| f1 EM2A Muc | CCTGCTGATCCACGACATCGAGACAAACCCTGGCCCCACCCCTGGAACCCAGAGCC | Sense | 88 |
| f1 ERBV2A cMuc | TGGCCGGCGACGTGGAACTGAACCCTGGCCCTACAGGCTCTGGCCACGCCAG | Sense | 89 |
| f1 ERBV2A Muc | TGGCCGGCGACGTGGAACTGAACCCTGGCCCTACCCCTGGAACCCAGAGCC | Sense | 90 |
| f1 ERBV2A Ter d342 | TGGCCGGCGACGTGGAACTGAACCCTGGCCCTAGCTTCCTCCTGTCGTCGCTCA | Sense | 91 |
| f1 ERBV2A Ter240 | TGGCCGGCGACGTGGAACTGAACCCTGGCCCTGGAGCTGCCCCGGAGCCGG | Sense | 92 |

-continued

| Primer | SEQUENCE (5' TO 3') | Strand | SEQ ID NO |
|---|---|---|---|
| f1 ERBV2A Tert d541 | TGGCCGGCGACGTGGAACTGAACCCTGGCCCTGCCAAATTTCTGCATTGGCTGATG | Sense | 93 |
| f1 PTV2A cMSLN | TGGAAGAGAACCCTGGCCCTCTGGCTGGCGAGACAGGACAGGA | Sense | 94 |
| f1 PTV2A Muc | TGGAAGAGAACCCTGGCCCTACCCCTGGAACCCAGAGCC | Sense | 95 |
| f1 T2A cMSLN | GCGACGTGGAAGAGAACCCTGGCCCCCTGGCTGGCGAGACAGGACAGGA | Sense | 96 |
| f1 T2A Tert d342 | GCGACGTGGAAGAGAACCCTGGCCCCAGCTTCCTCCTGTCGTCGCTCA | Sense | 97 |
| f1 T2A Tert d541 | GCGACGTGGAAGAGAACCCTGGCCCCGCCAAATTTCTGCATTGGCTGATG | Sense | 98 |
| f1 T2A Tert240 | GCGACGTGGAAGAGAACCCTGGCCCCGGAGCTGCCCCGGAGCCGG | Sense | 99 |
| f2 EMCV2A | AGAATCTTCAACGCCCACTACGCCGGCTACTTCGCCGACCTGCTGATCCACGACATCGA | Sense | 100 |
| f2 ERBV2A | TGTCTGAGGGCGCCACCAACTTCAGCCTGCTGAAACTGGCCGGCGACGTGGAACTG | Sense | 101 |
| f2 PTV2A | TTCAGCCTGCTGAAACAGGCCGGCGACGTGGAAGAGAACCCTGGCCCT | Sense | 102 |
| f2 T2A | CCGGCGAGGGCAGAGGCAGCCTGCTGACATGTGGCGACGTGGAAGAGAACCCTG | Sense | 103 |
| pMED_cMSLN_R-37 | GGGCCCAGATCTTCACAGGGCTTCCTGCATGCTCAGGTCCAGCAC | Antisense | 104 |
| pMED_MUC1_F-31 | ACGAACATGGCTAGCACCCCTGGAACCCAGAGCCCCTTC | Sense | 105 |
| r EM2A Bamh cMSLN | GTGGGCGTTGAAGATTCTGCCGGATCCCAGGGCTTCCTGCATGCTCAGGT | Antisense | 106 |
| r ERB2A Bamh Muc | TGGTGGCGCCCTCAGACAGGATTGTGCCGGATCCCAGGTTGGCGGAGGCAGCG | Antisense | 107 |
| r ERB2A Bamh Ter240 | TGGTGGCGCCCTCAGACAGGATTGTGCCGGATCCGTCCAAGATGGTCTTGAAATCTGA | Antisense | 108 |
| r link cMSLN | TCCGCCGGAGCCTCCCAGGGCTTCCTGCATGCTCAGGT | Antisense | 109 |
| r link muc | TCCGCCGGAGCCTCCCAGGTTGGCGGAGGCAGCG | Antisense | 110 |
| r link Tert240 | TCCGCCGGAGCCTCCGTCCAAGATGGTCTTGAAATCTGA | Antisense | 111 |
| r MSLN 1051-1033 | TGTCCTCGGGGCTCATCTT | Antisense | 112 |
| r nnuc 986- 63 | AAGGACAGAAAGAAGAATGAGACG | Antisense | 113 |
| r pmed Bgl cMSLN | TTGTTTTGTTAGGGCCCAGATCTTCACAGGGCTTCCTGCATGCTCAGG | Antisense | 114 |
| r pmed Bgl Muc | TTGTTTTGTTAGGGCCCAGATCTTCACAGGTTGGCGGAGGCAGCG | Antisense | 115 |
| r pmed Bgl Ter240 | TTGTTTTGTTAGGGCCCAGATCTTCAGTCCAAGATGGTCTTGAAATCTGA | Antisense | 116 |
| r PTV2A Bamh cMSLN | CTGTTTCAGCAGGCTGAAATTGGTGGCGCCGGATCCCAGGGCTTCCTGCATGCTCAGGT | Antisense | 117 |
| r PTV2A Bamh Muc | CTGTTTCAGCAGGCTGAAATTGGTGGCGCCGGATCCCAGGTTGGCGGAGGCAGCG | Antisense | 118 |

| Primer | SEQUENCE (5' TO 3') | Strand | SEQ ID NO |
|---|---|---|---|
| r T2A Bamh cMSLN | TGCCTCTGCCCTCGCCGGATCCCAGGGCTTCCTGCATGC TCAGGT | Antisense | 119 |
| r T2A Tert240 | TGCCTCTGCCCTCGCCGGATCCGTCCAAGATGGTCTTGA AATCTGA | Antisense | 120 |
| r tert 1602-1579 | AGGCTGGAGGTCGGTGAGAGTGGA | Antisense | 121 |
| r2 T2A | AGGGTTCTCTTCCACGTCGCCACATGTCAGCAGGCTGC CTCTGCCCTCGCCGGATCC | Antisense | 122 |
| TertΔ343-F | ACGAACATGGCTAGCTTCCTCCTGTCGTCGCTCAGACC GAG | Sense | 123 |
| Tert-R | TTGTTTTGTTAGGGCCCAGATCTTCAGTCCAAGATGGTC TTGAAATC | Antisense | 124 |
| TertΔ541-F | ACGAACATGGCTAGCGCCAAATTTCTGCATTGGCTGAT GTC | Sense | 125 |
| r TERT co# pMed | TTGTTTTGTTAGGGCCCAGATCTTCAGTCCAAGATGGTC TTGAAATC | Antisense | 126 |
| f pmd TERT 241G | ACCCTGTGACGAACATGGGAGCTGCCCCGGAGCCGGA GA | Sense | 127 |
| MSLN34 | CAACAAGCTAGCCTGGCTGGCGAGACAGGACA | Sense | 128 |
| M5LN598 | CAACAAAGATCTTTACAGGGCTTCCTGCATGCACAG | Antisense | 129 |
| ID1197F | ACCCTGTGACGAACATGGCTAGC | Sense | 130 |
| ID1197R | AGATCTGGGCCCTAACA | Antisense | 131 |

SEQUENCE LISTING (638 sequences)

SEQ ID NO: 1 - protein, 1255 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 2 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 3 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 4 - DNA, 30252 bp, Artificial Sequence
  Synthetic Construct
ccatcttcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttactactgtaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctgtccctatcagtgatagagatctccctatcagtgatagagagtttagtgaaccgtcagatccgctagggtaccgcgatcgcacctcgagctgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaccaggtgccgagcctgcgagtgcggagggaagcatgccaggttccagcccgtgtgtgtggatgtgacggaggacctgcgacccgatcatttggtgttgccctgcaccgggacggagttcggttccagcggggaagaatctgactagagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggcctcgactcccacctgcttcggatcttcagccagcgtccgatcctggtcgagcgcgagcaaggacagacccttctgactctgtactgcatctgcaaccaccccggcctgcatgaaagtctttgttgtctgctgtgtactgagtataataaaagctgagatcagcgactactccggacttccgtgtgtttaaactcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtggacgtttagagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatgg

SEQ ID NO: 5 - DNA, 1692 bp, Artificial Sequence
  Synthetic Construct
atggctagcctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctg

SEQ ID NO: 6 - protein, 564 aa, Artificial Sequence
  Synthetic Construct
MASLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEAL

SEQ ID NO: 7 - DNA, 1611 bp, Artificial Sequence
  Synthetic Construct
atggctagcacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctg

SEQ ID NO: 8 - protein, 537 aa, Artificial Sequence
  Synthetic Construct
MASTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 9 - DNA, 2679 bp, Artificial Sequence
  Synthetic Construct
atgggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 10 - protein, 893 aa, Artificial Sequence
  Synthetic Construct
MGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 11 - DNA, 1782 bp, Artificial Sequence
  Synthetic Construct
atggctagcgccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 12 - protein, 594 aa, Artificial Sequence
  Synthetic Construct
MASAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 13 - DNA, 2373 bp, Artificial Sequence
  Synthetic Construct
atggctagcttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 14 - protein, 791 aa, Artificial Sequence
  Synthetic Construct
MASFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 15 - DNA, 1551 bp, Artificial Sequence
  Synthetic Construct
atggctagcacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctg

SEQ ID NO: 16 - protein, 517 aa, Artificial Sequence
  Synthetic Construct
MASTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 17 - DNA, 3378 bp, Artificial Sequence
  Synthetic Construct
atggctagcctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcagaatcttcaacgcccactacgccggctacttcgccgacctgctgatccacgacatcgagacaaaccctggccccacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctg

SEQ ID NO: 18 - protein, 1126 aa, Artificial Sequence
  Synthetic Construct
MASLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGRIFNAHYAGYFADLLIHDIETNPGPTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 19 - DNA, 3378 bp, Artificial Sequence
  Synthetic Construct
atggctagcacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcagaatcttcaacgcccactacgccggctacttcgccgacctgctgatccacgacatcgagacaaaccctggccccctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctg

SEQ ID NO: 20 - protein, 1126 aa, Artificial Sequence
  Synthetic Construct
MASTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGRIFNAHYAGYFADLLIHDIETNPGPLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEAL

SEQ ID NO: 21 - DNA, 3360 bp, Artificial Sequence
  Synthetic Construct
atggctagcacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcgccaccaatttcagcctgctgaaacaggccggcgacgtggaagagaaccctggccctctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctg

SEQ ID NO: 22 - protein, 1120 aa, Artificial Sequence
  Synthetic Construct
MASTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGATNFSLLKQAGDVEENPGPLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEAL

SEQ ID NO: 23 - DNA, 3360 bp, Artificial Sequence
  Synthetic Construct
atggctagcctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcgccaccaatttcagcctgctgaaacaggccggcgacgtggaagagaaccctggccctacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctg

SEQ ID NO: 24 - protein, 1120 aa, Artificial Sequence
  Synthetic Construct
MASLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGATNFSLLKQAGDVEENPGPTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 25 - DNA, 4302 bp, Artificial Sequence
  Synthetic Construct
atggctagcacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggaggctccggcggaggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 26 - protein, 1434 aa, Artificial Sequence
  Synthetic Construct
MASTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGGSGGGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 27 - DNA, 4371 bp, Artificial Sequence
  Synthetic Construct
atggctagcacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcacaatcctgtctgagggcgccaccaacttcagcctgctgaaactggccggcgacgtggaactgaaccctggccctggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 28 - protein, 1457 aa, Artificial Sequence
  Synthetic Construct
MASTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGTILSEGATNFSLLKLAGDVELNPGPGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 29 - DNA, 4371 bp, Artificial Sequence
  Synthetic Construct
atggctagcggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggacggatccggcacaatcctgtctgagggcgccaccaacttcagcctgctgaaactggccggcgacgtggaactgaaccctggccctacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctg

SEQ ID NO: 30 - protein, 1457 aa, Artificial Sequence
  Synthetic Construct
MASGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILDGSGTILSEGATNFSLLKLAGDVELNPGPTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 31 - DNA, 4311 bp, Artificial Sequence
  Synthetic Construct
atggctagcacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcacaatcctgtctgagggcgccaccaacttcagcctgctgaaactggccggcgacgtggaactgaaccctggccctggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 32 - protein, 1437 aa, Artificial Sequence
  Synthetic Construct
MASTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGTILSEGATNFSLLKLAGDVELNPGPGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 33 - DNA, 4311 bp, Artificial Sequence
  Synthetic Construct
atggctagcggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggacggatccggcacaatcctgtctgagggcgccaccaacttcagcctgctgaaactggccggcgacgtggaactgaaccctggccctacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctg

SEQ ID NO: 34 - protein, 1437 aa, Artificial Sequence
  Synthetic Construct
MASGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILDGSGTILSEGATNFSLLKLAGDVELNPGPTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 35 - DNA, 4431 bp, Artificial Sequence
  Synthetic Construct
atggctagcggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggacggatccggcgagggcagaggcagcctgctgacatgtggcgacgtggaagagaaccctggccccctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctg

SEQ ID NO: 36 - protein, 1477 aa, Artificial Sequence
  Synthetic Construct
MASGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILDGSGEGRGSLLTCGDVEENPGPLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEAL

SEQ ID NO: 37 - DNA, 4383 bp, Artificial Sequence
  Synthetic Construct
atggctagcggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggacggaggctccggcggactggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctg

SEQ ID NO: 38 - protein, 1461 aa, Artificial Sequence
  Synthetic Construct
MASGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILDGGSGGLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEAL

SEQ ID NO: 39 - DNA, 4431 bp, Artificial Sequence
  Synthetic Construct
atggctagcctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcgagggcagaggcagcctgctgacatgtggcgacgtggaagagaaccctggccccggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 40 - protein, 1477 aa, Artificial Sequence
  Synthetic Construct
MASLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGEGRGSLLTCGDVEENPGPGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 41 - DNA, 4383 bp, Artificial Sequence
  Synthetic Construct
atggctagcctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggaggctccggcggaggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 42 - protein, 1461 aa, Artificial Sequence
  Synthetic Construct
MASLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGGSGGGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 43 - DNA, 6117 bp, Artificial Sequence
  Synthetic Construct
atggctagcacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcagaatcttcaacgcccactacgccggctacttcgccgacctgctgatccacgacatcgagacaaaccctggccccctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcgagggcagaggcagcctgctgacatgtggcgacgtggaagagaaccctggccccggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 44 - protein, 2039 aa, Artificial Sequence
  Synthetic Construct
MASTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGRIFNAHYAGYFADLLIHDIETNPGPLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGEGRGSLLTCGDVEENPGPGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 45 - DNA, 6117 bp, Artificial Sequence
  Synthetic Construct
atggctagcacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcacaatcctgtctgagggcgccaccaacttcagcctgctgaaactggccggcgacgtggaactgaaccctggccctggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggacggatccggcgagggcagaggcagcctgctgacatgtggcgacgtggaagagaaccctggccccctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctg

SEQ ID NO: 46 - protein, 2039 aa, Artificial Sequence
  Synthetic Construct
MASTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGTILSEGATNFSLLKLAGDVELNPGPGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILDGSGEGRGSLLTCGDVEENPGPLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEAL

SEQ ID NO: 47 - DNA, 6138 bp, Artificial Sequence
  Synthetic Construct
atggctagcctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcagaatcttcaacgcccactacgccggctacttcgccgacctgctgatccacgacatcgagacaaaccctggccccacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcacaatcctgtctgagggcgccaccaacttcagcctgctgaaactggccggcgacgtggaactgaaccctggccctggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 48 - protein, 2046 aa, Artificial Sequence
  Synthetic Construct
MASLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGRIFNAHYAGYFADLLIHDIETNPGPTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGTILSEGATNFSLLKLAGDVELNPGPGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 49 - DNA, 6117 bp, Artificial Sequence
  Synthetic Construct
atggctagcctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcgagggcagaggcagcctgctgacatgtggcgacgtggaagagaaccctggccccggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggacggatccggcacaatcctgtctgagggcgccaccaacttcagcctgctgaaactggccggcgacgtggaactgaaccctggccctacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctg

SEQ ID NO: 50 - protein, 2039 aa, Artificial Sequence
  Synthetic Construct
MASLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGEGRGSLLTCGDVEENPGPGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILDGSGTILSEGATNFSLLKLAGDVELNPGPTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 51 - DNA, 6117 bp, Artificial Sequence
  Synthetic Construct
atggctagcggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggacggatccggcgagggcagaggcagcctgctgacatgtggcgacgtggaagagaaccctggccccctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcagaatcttcaacgcccactacgccggctacttcgccgacctgctgatccacgacatcgagacaaaccctggccccacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctg

SEQ ID NO: 52 - protein, 2039 aa, Artificial Sequence
  Synthetic Construct
MASGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILDGSGEGRGSLLTCGDVEENPGPLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGRIFNAHYAGYFADLLIHDIETNPGPTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 53 - DNA, 6138 bp, Artificial Sequence
  Synthetic Construct
atggctagcggagctgccccggagccggagaggacccccgttggccagggatcgtgggcccatccgggacgcaccaggggaccatccgacaggggattctgtgtggtgtcaccggccaggccagcagaagaggcaaccagcctcgagggagcgttgtctggaaccagacattcccacccgtcggtgggccggcagcaccacgcgggaccaccgtccacttccagaccgccacggccatgggacaccccttgcccgcctgtgtatgccgagactaaacacttcctgtactcatccggagacaaggaacagcttcggccgtccttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggacggatccggcacaatcctgtctgagggcgccaccaacttcagcctgctgaaactggccggcgacgtggaactgaaccctggccctacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcagaatcttcaacgcccactacgccggctacttcgccgacctgctgatccacgacatcgagacaaaccctggccccctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctg

SEQ ID NO: 54 - protein, 2046 aa, Artificial Sequence
  Synthetic Construct
MASGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILDGSGTILSEGATNFSLLKLAGDVELNPGPTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGRIFNAHYAGYFADLLIHDIETNPGPLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEAL

SEQ ID NO: 55 - DNA, 5214 bp, Artificial Sequence
  Synthetic Construct
atggctagcacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcagaatcttcaacgcccactacgccggctacttcgccgacctgctgatccacgacatcgagacaaaccctggccccctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcgagggcagaggcagcctgctgacatgtggcgacgtggaagagaaccctggccccgccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 56 - protein, 1738 aa, Artificial Sequence
  Synthetic Construct
MASTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGRIFNAHYAGYFADLLIHDIETNPGPLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGEGRGSLLTCGDVEENPGPAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 57 - DNA, 5235 bp, Artificial Sequence
  Synthetic Construct
atggctagcctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcagaatcttcaacgcccactacgccggctacttcgccgacctgctgatccacgacatcgagacaaaccctggccccacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcacaatcctgtctgagggcgccaccaacttcagcctgctgaaactggccggcgacgtggaactgaaccctggccctgccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 58 - protein, 1745 aa, Artificial Sequence
  Synthetic Construct
MASLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGRIFNAHYAGYFADLLIHDIETNPGPTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGTILSEGATNFSLLKLAGDVELNPGPAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 59 - DNA, 5214 bp, Artificial Sequence
  Synthetic Construct
atggctagcctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcgagggcagaggcagcctgctgacatgtggcgacgtggaagagaaccctggccccgccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggacggatccggcacaatcctgtctgagggcgccaccaacttcagcctgctgaaactggccggcgacgtggaactgaaccctggccctacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctg

SEQ ID NO: 60 - protein, 1738 aa, Artificial Sequence
  Synthetic Construct
MASLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGEGRGSLLTCGDVEENPGPAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILDGSGTILSEGATNFSLLKLAGDVELNPGPTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 61 - DNA, 5808 bp, Artificial Sequence
  Synthetic Construct
atggctagcacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcagaatcttcaacgcccactacgccggctacttcgccgacctgctgatccacgacatcgagacaaaccctggccccctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcgagggcagaggcagcctgctgacatgtggcgacgtggaagagaaccctggccccagcttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 62 - protein, 1936 aa, Artificial Sequence
  Synthetic Construct
MASTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGRIFNAHYAGYFADLLIHDIETNPGPLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGEGRGSLLTCGDVEENPGPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 63 - DNA, 5829 bp, Artificial Sequence
  Synthetic Construct
atggctagcctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcagaatcttcaacgcccactacgccggctacttcgccgacctgctgatccacgacatcgagacaaaccctggccccacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctgggatccggcacaatcctgtctgagggcgccaccaacttcagcctgctgaaactggccggcgacgtggaactgaaccctggccctagcttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggac

SEQ ID NO: 64 - protein, 1943 aa, Artificial Sequence
  Synthetic Construct
MASLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGRIFNAHYAGYFADLLIHDIETNPGPTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANLGSGTILSEGATNFSLLKLAGDVELNPGPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 65 - DNA, 5808 bp, Artificial Sequence
  Synthetic Construct
atggctagcctggctggcgagacaggacaggaagccgctcctctggacggcgtgctggccaaccctcccaatatcagcagcctgagccccagacagctgctgggattcccttgtgccgaggtgtccggcctgagcacagagagagtgcgggaactggctgtggccctggcccagaaaaacgtgaagctgagcaccgagcagctgcggtgcctggcccacagactgtctgagcctcccgaggatctggacgccctgcctctggatctgctgctgttcctgaaccccgacgccttcagcggacctcaggcctgcacccggttcttcagcagaatcaccaaggccaacgtggacctgctgcccagaggcgcccctgagagacagagactgctgcctgctgctctggcctgttggggagtgcggggctctctgctgtctgaagctgatgtgcgggccctgggaggcctggcttgtgatctgcctggaagattcgtggccgagagcgccgaagtgctgctgcctagactggtgtcctgtcccggccctctggaccaggatcagcaggaagctgccagagctgctctgcagggcggaggccctccttatggacctcctagcacttggagcgtgtccaccatggatgccctgaggggcctgctgccagtgctgggccagcctatcatcagatccatcccacagggcatcgtggccgcctggcggcagagaagctctagagatccctcttggcggcagcccgagcggacaatcctgcggcccaggtttcggagagaggtggaaaagaccgcctgcccctctggcaagaaggccagagagatcgacgagagcctgatcttctacaagaagtgggagctggaagcctgcgtggacgccgctctgctggccacccagatggacagagtgaacgccatccccttcacctatgagcagctggacgtgctgaagcacaagctggatgagctgtacccccagggctaccccgagagcgtgatccagcacctgggctacctgtttctgaagatgagccccgaggacatccggaagtggaacgtgaccagcctggaaaccctgaaggccctgctggaagtgaacaagggccacgagatgtccccccaggtggccacactgatcgacagattcgtgaagggcagaggccagctggacaaggacaccctggatacactgaccgccttctaccccggctatctgtgcagcctgtcccccgaggaactgagcagcgtgccacctagctctatctgggctgtgcggccccaggacctggatacctgcgatcctagacagctggatgtgctgtatcccaaggcccggctggccttccagaacatgaacggcagcgagtacttcgtgaagatccagtccttcctgggcggagcccctaccgaggacctgaaagctctgagccagcagaacgtgtccatggatctggccacctttatgaagctgcggaccgacgccgtgctgcctctgacagtggctgaggtgcagaaactgctgggcccccatgtggaagggctgaaggccgaagaacggcacagacccgtgcgcgactggatcctgaggcagagacaggatgacctggacacactgggcctgggactgcaggggggcatccctaatggctacctggtgctggacctgagcatgcaggaagccctgggatccggcgagggcagaggcagcctgctgacatgtggcgacgtggaagagaaccctggccccagcttcctcctgtcgtcgctcagaccgagcctgaccggagcacgcagattggtggaaactatcttccttgggtcacgtccgtggatgccaggtaccccacggcgcctcccgcgcctcccacagagatactggcagatgcggcctctgttcctggaattgctgggaaaccacgctcagtgcccgtacggagtcctgctcaagactcactgccctctgagggcggcggtcactccggcggccggagtgtgcgcacgggagaagccccagggaagcgtggcagctccggaagaggaggacaccgatccgcgccgcctcgtgcaacttctgcgccagcactcctcgccctggcaagtctacgggttcgtccgcgcctgcctgcgccgcctggtgccgcctgggctctggggttcccggcataacgagcgccgcttcctgagaaatactaagaagtttatctcacttggaaaacatgccaagttgtcgctgcaagaactcacgtggaagatgtcagtccgcgattgcgcctggctgcgccgctcgccgggcgtcgggtgtgttccagctgcagaacaccgcctgagagaagaaattctggccaaatttctgcattggctgatgtcagtgtacgtggtcgagctgctgcgctcctttttctacgtcactgagactacctttcaaaagaaccgcctgttcttctaccgcaaatctgtgtggagcaagctgcagtcaatcggcattcgccagcatctgaagagggtgcagctgcgggaactttccgaggcagaagtccgccagcaccgggaggcccggccggcgcttctcacgtcgcgtctgagattcatcccaaagcccgacgggctgaggcctatcgtcaacatggattacgtcgtgggcgctcgcacctttcgccgtgaaaagcgggccgaacgcttgacctcacgggtgaaggccctcttctccgtgctgaactacgagagagcaagacggcctggcctgctgggagcttcggtgctgggactggacgatatccaccgggcttggcggacctttgttctccgggtgagagcccaagaccctccgccggaactgtacttcgtgaaggtggcgatcaccggagcctatgatactattccgcaagatcgactcaccgaagtcatcgcctcgatcatcaaaccgcagaacacttactgcgtcaggcggtacgccgtggtccagaaggccgcgcatggccacgtgagaaaggcgttcaagtcgcacgtgtccactctcaccgacctccagccttacatgaggcaattcgttgcgcatttgcaagagacttcgcccctgagagatgcggtggtcatcgagcagagctccagcctgaacgaagcgagcagcggtctgtttgacgtgttcctccgcttcatgtgtcatcacgcggtgcgaatcaggggaaaatcatacgtgcagtgccagggaatcccacaaggcagcattctgtcgactctcttgtgttccctttgctacggcgatatggaaaacaagctgttcgctgggatcagacgggacgggttgctgctcagactggtggacgacttcctgctggtgactccgcacctcactcacgccaaaacctttctccgcactctggtgaggggagtgccagaatacggctgtgtggtcaatctccggaaaactgtggtgaatttccctgtcgaggatgaggcactcggaggaaccgcatttgtccaaatgccagcacatggcctgttcccatggtgcggtctgctgctggacacccgaactcttgaagtgcagtccgactactccagctatgcccggacgagcatccgcgccagcctcactttcaatcgcggctttaaggccggacgaaacatgcgcagaaagcttttcggagtcctccggcttaaatgccattcgctctttctcgatctccaagtcaattcgctgcagaccgtgtgcacgaacatctacaagatcctgctgctccaagcctaccggttccacgcttgcgtgcttcagctgccgtttcaccaacaggtgtggaagaacccgaccttctttctgcgggtcattagcgatactgcctccctgtgttactcaatcctcaaggcaaagaacgccggaatgtcgctgggtgcgaaaggagccgcgggacctcttcctagcgaagcggtgcagtggctctgccaccaggctttcctcctgaagctgaccaggcacagagtgacctacgtcccgctgctgggctcgctgcgcactgcacagacccagctgtctagaaaactccccggcaccaccctgaccgctctggaagccgccgccaacccagcattgccgtcagatttcaagaccatcttggacggatccggcacaatcctgtctgagggcgccaccaacttcagcctgctgaaactggccggcgacgtggaactgaaccctggccctacccctggaacccagagccccttcttccttctgctgctgctgaccgtgctgactgtcgtgacaggctctggccacgccagctctacacctggcggcgagaaagagacaagcgccacccagagaagcagcgtgccaagcagcaccgagaagaacgccgtgtccatgaccagctccgtgctgagcagccactctcctggcagcggcagcagcacaacacagggccaggatgtgacactggcccctgccacagaacctgcctctggatctgccgccacctggggacaggacgtgacaagcgtgccagtgaccagacctgccctgggctctacaacaccccctgcccacgatgtgaccagcgcccctgataacaagcctgcccctggaagcacagcccctccagctcatggcgtgacctctgccccagataccagaccagccccaggatctacagccccacccgcacacggcgtgacaagtgcccctgacacaagacccgctccaggctctactgctcctcctgcccatggcgtgacaagcgctcccgatacaaggccagctcctggctccacagcaccaccagcacatggcgtgacatcagctcccgacactagacctgctcccggatcaaccgctccaccagctcacggcgtgaccagcgcacctgataccagacctgctctgggaagcaccgcccctcccgtgcacaatgtgacatctgcttccggcagcgccagcggctctgcctctacactggtgcacaacggcaccagcgccagagccacaacaaccccagccagcaagagcacccccttcagcatccctagccaccacagcgacacccctaccacactggccagccactccaccaagaccgatgcctctagcacccaccactccagcgtgccccctctgaccagcagcaaccacagcacaagcccccagctgtctaccggcgtctcattcttctttctgtccttccacatcagcaacctgcagttcaacagcagcctggaagatcccagcaccgactactaccaggaactgcagcgggatatcagcgagatgttcctgcaaatctacaagcagggcggcttcctgggcctgagcaacatcaagttcagacccggcagcgtggtggtgcagctgaccctggctttccgggaaggcaccatcaacgtgcacgacgtggaaacccagttcaaccagtacaagaccgaggccgccagccggtacaacctgaccatctccgatgtgtccgtgtccgacgtgcccttcccattctctgcccagtctggcgcaggcgtgccaggatggggaattgctctgctggtgctcgtgtgcgtgctggtggccctggccatcgtgtatctgattgccctggccgtgtgccagtgccggcggaagaattacggccagctggacatcttccccgccagagacacctaccaccccatgagcgagtaccccacataccacacccacggcagatacgtgccacccagctccaccgacagatccccctacgagaaagtgtctgccggcaacggcggcagctccctgagctacacaaatcctgccgtggccgctgcctccgccaacctg

SEQ ID NO: 66 - protein, 1936 aa, Artificial Sequence
  Synthetic Construct
MASLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALGSGEGRGSLLTCGDVEENPGPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILDGSGTILSEGATNFSLLKLAGDVELNPGPTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 67 - DNA, 84 bp, Artificial Sequence
  Synthetic Construct
ggatccggcagaatcttcaacgcccactacgccggctacttcgccgacctgctgatccacgacatcgagacaaaccctggcccc

SEQ ID NO: 68 - protein, 28 aa, Artificial Sequence
  Synthetic Construct
GSGRIFNAHYAGYFADLLIHDIETNPGP

SEQ ID NO: 69 - DNA, 63 bp, Artificial Sequence
  Synthetic Construct
ggatccggcgagggcagaggcagcctgctgacatgtggcgacgtggaagagaaccctggcccc

SEQ ID NO: 70 - protein, 21 aa, Artificial Sequence
  Synthetic Construct
GSGEGRGSLLTCGDVEENPGP

SEQ ID NO: 71 - DNA, 84 bp, Artificial Sequence
  Synthetic Construct
ggatccggcacaatcctgtctgagggcgccaccaacttcagcctgctgaaactggccggcgacgtggaactgaaccctggccct

SEQ ID NO: 72 - protein, 28 aa, Artificial Sequence
  Synthetic Construct
GSGTILSEGATNFSLLKLAGDVELNPGP

SEQ ID NO: 73 - DNA, 66 bp, Artificial Sequence
  Synthetic Construct
ggatccggcgccaccaatttcagcctgctgaaacaggccggcgacgtggaagagaaccctggccct

SEQ ID NO: 74 - protein, 22 aa, Artificial Sequence
  Synthetic Construct
GSGATNFSLLKQAGDVEENPGP

SEQ ID NO: 75 - DNA, 43 bp, Artificial Sequence
  Synthetic Construct
gagacaaaccctggccccctggctggcgagacaggacaggaag

SEQ ID NO: 76 - DNA, 46 bp, Artificial Sequence
  Synthetic Construct
gttgaagattctgccggatcccaggttggcggaggcagcggccacg

SEQ ID NO: 77 - DNA, 47 bp, Artificial Sequence
  Synthetic Construct
gctacttcgccgacctgctgatccacgacatcgagacaaaccctggc

SEQ ID NO: 78 - DNA, 47 bp, Artificial Sequence
  Synthetic Construct
ggtcggcgaagtagccggcgtagtgggcgttgaagattctgccggat

SEQ ID NO: 79 - DNA, 24 bp, Artificial Sequence
  Synthetic Construct
ttctgaagatgagccccgaggaca

SEQ ID NO: 80 - DNA, 24 bp, Artificial Sequence
  Synthetic Construct
cggcgtctcattcttctttctgtc

SEQ ID NO: 81 - DNA, 46 bp, Artificial Sequence
  Synthetic Construct
accctgtgacgaacatggctagcctggctggcgagacaggacagga

SEQ ID NO: 82 - DNA, 43 bp, Artificial Sequence
  Synthetic Construct
accctgtgacgaacatggctagcacaggctctggccacgccag

SEQ ID NO: 83 - DNA, 42 bp, Artificial Sequence
  Synthetic Construct
accctgtgacgaacatggctagcacccctggaacccagagcc

SEQ ID NO: 84 - DNA, 42 bp, Artificial Sequence
  Synthetic Construct
accctgtgacgaacatggctagcggagctgccccggagccgg

SEQ ID NO: 85 - DNA, 24 bp, Artificial Sequence
  Synthetic Construct
tctcaccgacctccagccttacat

SEQ ID NO: 86 - DNA, 37 bp, Artificial Sequence
  Synthetic Construct
acggaggctccggcggactggctggcgagacaggaca

SEQ ID NO: 87 - DNA, 36 bp, Artificial Sequence
  Synthetic Construct
tgggaggctccggcggaggagctgccccggagccgg

SEQ ID NO: 88 - DNA, 56 bp, Artificial Sequence
  Synthetic Construct
cctgctgatccacgacatcgagacaaaccctggccccacccctggaacccagagcc

SEQ ID NO: 89 - DNA, 52 bp, Artificial Sequence
  Synthetic Construct
tggccggcgacgtggaactgaaccctggccctacaggctctggccacgccag

SEQ ID NO: 90 - DNA, 51 bp, Artificial Sequence
  Synthetic Construct
tggccggcgacgtggaactgaaccctggccctacccctggaacccagagcc

SEQ ID NO: 91 - DNA, 54 bp, Artificial Sequence
  Synthetic Construct
tggccggcgacgtggaactgaaccctggccctagcttcctcctgtcgtcgctca

SEQ ID NO: 92 - DNA, 51 bp, Artificial Sequence
  Synthetic Construct
tggccggcgacgtggaactgaaccctggccctggagctgccccggagccgg

SEQ ID NO: 93 - DNA, 56 bp, Artificial Sequence
  Synthetic Construct
tggccggcgacgtggaactgaaccctggccctgccaaatttctgcattggctgatg

SEQ ID NO: 94 - DNA, 43 bp, Artificial Sequence
  Synthetic Construct
tggaagagaaccctggccctctggctggcgagacaggacagga

SEQ ID NO: 95 - DNA, 39 bp, Artificial Sequence
  Synthetic Construct
tggaagagaaccctggccctacccctggaacccagagcc

SEQ ID NO: 96 - DNA, 49 bp, Artificial Sequence
  Synthetic Construct
gcgacgtggaagagaaccctggccccctggctggcgagacaggacagga

SEQ ID NO: 97 - DNA, 48 bp, Artificial Sequence
  Synthetic Construct
gcgacgtggaagagaaccctggccccagcttcctcctgtcgtcgctca

SEQ ID NO: 98 - DNA, 50 bp, Artificial Sequence
  Synthetic Construct
gcgacgtggaagagaaccctggccccgccaaatttctgcattggctgatg

SEQ ID NO: 99 - DNA, 45 bp, Artificial Sequence
  Synthetic Construct
gcgacgtggaagagaaccctggccccggagctgccccggagccgg

SEQ ID NO: 100 - DNA, 59 bp, Artificial Sequence
  Synthetic Construct
agaatcttcaacgcccactacgccggctacttcgccgacctgctgatccacgacatcga

SEQ ID NO: 101 - DNA, 56 bp, Artificial Sequence
  Synthetic Construct
tgtctgagggcgccaccaacttcagcctgctgaaactggccggcgacgtggaactg

SEQ ID NO: 102 - DNA, 48 bp, Artificial Sequence
  Synthetic Construct
ttcagcctgctgaaacaggccggcgacgtggaagagaaccctggccct

SEQ ID NO: 103 - DNA, 54 bp, Artificial Sequence
  Synthetic Construct
ccggcgagggcagaggcagcctgctgacatgtggcgacgtggaagagaaccctg

SEQ ID NO: 104 - DNA, 45 bp, Artificial Sequence
  Synthetic Construct
gggcccagatcttcacagggcttcctgcatgctcaggtccagcac

SEQ ID NO: 105 - DNA, 39 bp, Artificial Sequence
  Synthetic Construct
acgaacatggctagcacccctggaacccagagccccttc

SEQ ID NO: 106 - DNA, 50 bp, Artificial Sequence
  Synthetic Construct
gtgggcgttgaagattctgccggatcccagggcttcctgcatgctcaggt

SEQ ID NO: 107 - DNA, 53 bp, Artificial Sequence
  Synthetic Construct
tggtggcgccctcagacaggattgtgccggatcccaggttggcggaggcagcg

SEQ ID NO: 108 - DNA, 58 bp, Artificial Sequence
  Synthetic Construct
tggtggcgccctcagacaggattgtgccggatccgtccaagatggtcttgaaatctga

SEQ ID NO: 109 - DNA, 38 bp, Artificial Sequence
  Synthetic Construct
tccgccggagcctcccagggcttcctgcatgctcaggt

SEQ ID NO: 110 - DNA, 34 bp, Artificial Sequence
  Synthetic Construct
tccgccggagcctcccaggttggcggaggcagcg

SEQ ID NO: 111 - DNA, 39 bp, Artificial Sequence
  Synthetic Construct
tccgccggagcctccgtccaagatggtcttgaaatctga

SEQ ID NO: 112 - DNA, 19 bp, Artificial Sequence
  Synthetic Construct
tgtcctcggggctcatctt

SEQ ID NO: 113 - DNA, 24 bp, Artificial Sequence
  Synthetic Construct
aaggacagaaagaagaatgagacg

SEQ ID NO: 114 - DNA, 48 bp, Artificial Sequence
  Synthetic Construct
ttgttttgttagggcccagatcttcacagggcttcctgcatgctcagg

SEQ ID NO: 115 - DNA, 45 bp, Artificial Sequence
  Synthetic Construct
ttgttttgttagggcccagatcttcacaggttggcggaggcagcg

SEQ ID NO: 116 - DNA, 50 bp, Artificial Sequence
  Synthetic Construct
ttgttttgttagggcccagatcttcagtccaagatggtcttgaaatctga

SEQ ID NO: 117 - DNA, 59 bp, Artificial Sequence
  Synthetic Construct
ctgtttcagcaggctgaaattggtggcgccggatcccagggcttcctgcatgctcaggt

SEQ ID NO: 118 - DNA, 55 bp, Artificial Sequence
  Synthetic Construct
ctgtttcagcaggctgaaattggtggcgccggatcccaggttggcggaggcagcg

SEQ ID NO: 119 - DNA, 45 bp, Artificial Sequence
  Synthetic Construct
tgcctctgccctcgccggatcccagggcttcctgcatgctcaggt

SEQ ID NO: 120 - DNA, 46 bp, Artificial Sequence
  Synthetic Construct
tgcctctgccctcgccggatccgtccaagatggtcttgaaatctga

SEQ ID NO: 121 - DNA, 24 bp, Artificial Sequence
  Synthetic Construct
aggctggaggtcggtgagagtgga

SEQ ID NO: 122 - DNA, 57 bp, Artificial Sequence
  Synthetic Construct
agggttctcttccacgtcgccacatgtcagcaggctgcctctgccctcgccggatcc

SEQ ID NO: 123 - DNA, 41 bp, Artificial Sequence
  Synthetic Construct
acgaacatggctagcttcctcctgtcgtcgctcagaccgag

SEQ ID NO: 124 - DNA, 47 bp, Artificial Sequence
  Synthetic Construct
ttgttttgttagggcccagatcttcagtccaagatggtcttgaaatc

SEQ ID NO: 125 - DNA, 41 bp, Artificial Sequence
  Synthetic Construct
acgaacatggctagcgccaaatttctgcattggctgatgtc

SEQ ID NO: 126 - DNA, 47 bp, Artificial Sequence; identical to SEQ ID NO: 124
  Synthetic Construct

SEQ ID NO: 127 - DNA, 39 bp, Artificial Sequence
  Synthetic Construct
accctgtgacgaacatgggagctgccccggagccggaga

SEQ ID NO: 128 - DNA, 32 bp, Artificial Sequence
  Synthetic Construct
caacaagctagcctggctggcgagacaggaca

SEQ ID NO: 129 - DNA, 36 bp, Artificial Sequence
  Synthetic Construct
caacaaagatctttacagggcttcctgcatgcacag

SEQ ID NO: 130 - DNA, 23 bp, Artificial Sequence
  Synthetic Construct
accctgtgacgaacatggctagc

SEQ ID NO: 131 - DNA, 17 bp, Artificial Sequence
  Synthetic Construct
agatctgggccctaaca

SEQ ID NO: 132 - protein, 15 aa, Artificial Sequence
  Synthetic Construct
MASTPGTQSPFFLLL

SEQ ID NO: 133 - protein, 15 aa, Artificial Sequence
  Synthetic Construct
TPGTQSPFFLLLLLT

SEQ ID NO: 134 - protein, 15 aa, Artificial Sequence
  Synthetic Construct
TQSPFFLLLLLTVLT

SEQ ID NO: 135 - protein, 15 aa, Artificial Sequence
  Synthetic Construct
FFLLLLLTVLTVVTG

SEQ ID NO: 136 - protein, 15 aa, Artificial Sequence
  Synthetic Construct
LLLTVLTVVTGSGHA

SEQ ID NO: 137 - protein, 15 aa, Artificial Sequence
  Synthetic Construct
VLTVVTGSGHASSTP

SEQ ID NO: 138 - protein, 15 aa, Artificial Sequence
  Synthetic Construct
VTGSGHASSTPGGEK

SEQ ID NO: 139 - protein, 15 aa, Artificial Sequence
  Synthetic Construct
GHASSTPGGEKETSA

SEQ ID NO: 140 - protein, 15 aa, Artificial Sequence
  Synthetic Construct
STPGGEKETSATQRS

SEQ ID NO: 141 - protein, 15 aa, Artificial Sequence
  Synthetic Construct
GEKETSATQRSSVPS

SEQ ID NO: 142 - protein, 15 aa, Artificial Sequence
  Synthetic Construct
TSATQRSSVPSSTEK

SEQ ID NO: 143 - protein, 15 aa, Artificial Sequence
  Synthetic Construct
QRSSVPSSTEKNAVS

SEQ ID NO: 144 - protein, 15 aa, Artificial Sequence
  Synthetic Construct
VPSSTEKNAVSMTSS

SEQ ID NO: 145 - protein, 15 aa, Artificial Sequence
  Synthetic Construct
TEKNAVSMTSSVLSS

SEQ ID NO: 146 - protein, 15 aa, Artificial Sequence
  Synthetic Construct
AVSMTSSVLSSHSPG

SEQ ID NO: 147 - protein, 15 aa, Artificial Sequence
  Synthetic Construct
TSSVLSSHSPGSGSS

SEQ ID NO: 148 - protein, 15 aa, Artificial Sequence
  Synthetic Construct
LSSHSPGSGSSTTQG

SEQ ID NO: 149 - protein, 15 aa, Artificial Sequence
  Synthetic Construct
SPGSGSSTTQGQDVT

SEQ ID NO: 150 - protein, 15 aa, Artificial Sequence
  Synthetic Construct
GSSTTQGQDVTLAPA

SEQ ID NO: 151 - protein, 15 aa, Artificial Sequence
  Synthetic Construct
TQGQDVTLAPATEPA

SEQ ID NO: 152 - protein, 15 aa, Artificial Sequence
  Synthetic Construct
DVTLAPATEPASGSA

SEQ ID NO: 153 - protein, 15 aa, Artificial Sequence
  Synthetic Construct
APATEPASGSAATWG

SEQ ID NO: 154 - protein, 15 aa, Artificial Sequence
  Synthetic Construct
EPASGSAATWGQDVT

SEQ ID NO: 155 - protein, 15 aa, Artificial Sequence
  Synthetic Construct
GSAATWGQDVTSVPV

SEQ ID NO: 156 - protein, 15 aa, Artificial Sequence
  Synthetic Construct
TWGQDVTSVPVTRPA

SEQ ID NO: 157 - protein, 15 aa, Artificial Sequence
  Synthetic Construct
DVTSVPVTRPALGST

SEQ ID NO: 158 - protein, 15 aa, Artificial Sequence
  Synthetic Construct
VPVTRPALGSTTPPA

SEQ ID NO: 159 - protein, 15 aa, Artificial Sequence
  Synthetic Construct
RPALGSTTPPAHDVT

SEQ ID NO: 160 - protein, 15 aa, Artificial Sequence
  Synthetic Construct
GSTTPPAHDVTSAPD

SEQ ID NO: 161 - protein, 15 aa, Artificial Sequence
  Synthetic Construct
PPAHDVTSAPDNKPA

SEQ ID NO: 162 - protein, 15 aa, Artificial Sequence
  Synthetic Construct
DVTSAPDNKPAPGST

SEQ ID NO: 163 - protein, 15 aa, Artificial Sequence
  Synthetic Construct
APDNKPAPGSTAPPA

SEQ ID NO: 164 - protein, 15 aa, Artificial Sequence
  Synthetic Construct
KPAPGSTAPPAHGVT

SEQ ID NO: 165 - protein, 15 aa, Artificial Sequence
  Synthetic Construct
GSTAPPAHGVTSAPD

SEQ ID NO: 166 - protein, 15 aa, Artificial Sequence
  Synthetic Construct
PPAHGVTSAPDTRPA

SEQ ID NO: 167 - protein, 15 aa, Artificial Sequence
  Synthetic Construct
GVTSAPDTRPAPGST

SEQ ID NO: 168 - protein, 15 aa, Artificial Sequence
  Synthetic Construct
APDTRPAPGSTAPPA

SEQ ID NO: 169 - protein, 15 aa, Artificial Sequence
  Synthetic Construct
RPAPGSTAPPAHGVT

SEQ ID NO: 170 - protein, 15 aa, Artificial Sequence
  Synthetic Construct
GVTSAPDTRPALGST

SEQ ID NO: 171 - protein, 15 aa, Artificial Sequence
  Synthetic Construct
APDTRPALGSTAPPV

SEQ ID NO: 172 - protein, 15 aa, Artificial Sequence
  Synthetic Construct
RPALGSTAPPVHNVT

SEQ ID NO: 173 - protein, 15 aa, Artificial Sequence
  Synthetic Construct
GSTAPPVHNVTSASG

SEQ ID NO: 174 - protein, 15 aa, Artificial Sequence
  Synthetic Construct
PPVHNVTSASGSASG

SEQ ID NO: 175 - protein, 15 aa, Artificial Sequence
  Synthetic Construct
NVTSASGSASGSAST

SEQ ID NO: 176 - protein, 15 aa, Artificial Sequence
  Synthetic Construct
ASGSASGSASTLVHN

SEQ ID NO: 177 - protein, 15 aa, Artificial Sequence
  Synthetic Construct
ASGSASTLVHNGTSA

SEQ ID NO: 178 - protein, 15 aa, Artificial Sequence
  Synthetic Construct
ASTLVHNGTSARATT

SEQ ID NO: 179 - protein, 15 aa, Artificial Sequence
  Synthetic Construct
VHNGTSARATTTPAS

SEQ ID NO: 180 - protein, 15 aa, Artificial Sequence
  Synthetic Construct
TSARATTTPASKSTP

SEQ ID NO: 181 - protein, 15 aa, Artificial Sequence
  Synthetic Construct
ATTTPASKSTPFSIP

SEQ ID NO: 182 - protein, 15 aa, Artificial Sequence
  Synthetic Construct
PASKSTPFSIPSHHS

SEQ ID NO: 183 - protein, 15 aa, Artificial Sequence
  Synthetic Construct
STPFSIPSHHSDTPT

SEQ ID NO: 184 - protein, 15 aa, Artificial Sequence
  Synthetic Construct
SIPSHHSDTPTTLAS

SEQ ID NO: 185 - protein, 15 aa, Artificial Sequence
  Synthetic Construct
HHSDTPTTLASHSTK

SEQ ID NO: 186 - protein, 15 aa, Artificial Sequence
  Synthetic Construct
TPTTLASHSTKTDAS

SEQ ID NO: 187 - protein, 15 aa, Artificial Sequence
  Synthetic Construct
LASHSTKTDASSTHH

SEQ ID NO: 188 - protein, 15 aa, Artificial Sequence
  Synthetic Construct
STKTDASSTHHSSVP

SEQ ID NO: 189 - protein, 15 aa, Artificial Sequence
  Synthetic Construct
DASSTHHSSVPPLTS

SEQ ID NO: 190 - protein, 15 aa, Artificial Sequence
  Synthetic Construct
THHSSVPPLTSSNHS

SEQ ID NO: 191 - protein, 15 aa, Artificial Sequence
  Synthetic Construct
SVPPLTSSNHSTSPQ

SEQ ID NO: 192 - protein, 15 aa, Artificial Sequence
  Synthetic Construct
LTSSNHSTSPQLSTG

SEQ ID NO: 193 - protein, 15 aa, Artificial Sequence
  Synthetic Construct
NHSTSPQLSTGVSFF

SEQ ID NO: 194 - protein, 15 aa, Artificial Sequence
  Synthetic Construct
SPQLSTGVSFFFLSF

SEQ ID NO: 195 - protein, 15 aa, Artificial Sequence
  Synthetic Construct
STGVSFFFLSFHISN

SEQ ID NO: 196 - protein, 15 aa, Artificial Sequence
  Synthetic Construct
SFFFLSFHISNLQFN

SEQ ID NO: 197 - protein, 15 aa, Artificial Sequence
  Synthetic Construct
LSFHISNLQFNSSLE

SEQ ID NO: 198 - protein, 15 aa, Artificial Sequence
  Synthetic Construct
ISNLQFNSSLEDPST

SEQ ID NO: 199 - protein, 15 aa, Artificial Sequence
  Synthetic Construct
QFNSSLEDPSTDYYQ

SEQ ID NO: 200 - protein, 15 aa, Artificial Sequence
  Synthetic Construct
SLEDPSTDYYQELQR

SEQ ID NO: 201 - protein, 15 aa, Artificial Sequence
  Synthetic Construct
PSTDYYQELQRDISE

SEQ ID NO: 202 - protein, 15 aa, Artificial Sequence
  Synthetic Construct
YYQELQRDISEMFLQ

SEQ ID NO: 203 - protein, 15 aa, Artificial Sequence
  Synthetic Construct
LQRDISEMFLQIYKQ

SEQ ID NO: 204 - protein, 15 aa, Artificial Sequence
  Synthetic Construct
ISEMFLQIYKQGGFL

SEQ ID NO: 205 - protein, 15 aa, Artificial Sequence
  Synthetic Construct
FLQIYKQGGFLGLSN

SEQ ID NO: 206 - protein, 15 aa, Artificial Sequence
  Synthetic Construct
YKQGGFLGLSNIKFR

SEQ ID NO: 207 - protein, 15 aa, Artificial Sequence
  Synthetic Construct
GFLGLSNIKFRPGSV

SEQ ID NO: 208 - protein, 15 aa, Artificial Sequence
  Synthetic Construct
LSNIKFRPGSVVVQL

SEQ ID NO: 209 - protein, 15 aa, Artificial Sequence
  Synthetic Construct
KFRPGSVVVQLTLAF

SEQ ID NO: 210 - protein, 15 aa, Artificial Sequence
  Synthetic Construct
GSVVVQLTLAFREGT

SEQ ID NO: 211 - protein, 15 aa, Artificial Sequence
  Synthetic Construct
VVVQLTLAFREGTIN

SEQ ID NO: 212 - protein, 15 aa, Artificial Sequence
  Synthetic Construct
QLTLAFREGTINVHD

SEQ ID NO: 213 - protein, 15 aa, Artificial Sequence
  Synthetic Construct
AFREGTINVHDVETQ

SEQ ID NO: 214 - protein, 15 aa, Artificial Sequence
  Synthetic Construct
GTINVHDVETQFNQY

SEQ ID NO: 215 - protein, 15 aa, Artificial Sequence
  Synthetic Construct
VHDVETQFNQYKTEA

SEQ ID NO: 216 - protein, 15 aa, Artificial Sequence
  Synthetic Construct
ETQFNQYKTEAASRY

SEQ ID NO: 217 - protein, 15 aa, Artificial Sequence
  Synthetic Construct
NQYKTEAASRYNLTI

SEQ ID NO: 218 - protein, 15 aa, Artificial Sequence
  Synthetic Construct
TEAASRYNLTISDVS

SEQ ID NO: 219 - protein, 15 aa, Artificial Sequence
  Synthetic Construct
SRYNLTISDVSVSDV

SEQ ID NO: 220 - protein, 15 aa, Artificial Sequence
  Synthetic Construct
LTISDVSVSDVPFPF

SEQ ID NO: 221 - protein, 15 aa, Artificial Sequence
  Synthetic Construct
DVSVSDVPFPFSAQS

SEQ ID NO: 222 - protein, 15 aa, Artificial Sequence
  Synthetic Construct
SDVPFPFSAQSGAGV

SEQ ID NO: 223 - protein, 15 aa, Artificial Sequence
  Synthetic Construct
FPFSAQSGAGVPGWG

SEQ ID NO: 224 - protein, 15 aa, Artificial Sequence
  Synthetic Construct
AQSGAGVPGWGIALL

SEQ ID NO: 225 - protein, 15 aa, Artificial Sequence
  Synthetic Construct
AGVPGWGIALLVLVC

SEQ ID NO: 226 - protein, 15 aa, Artificial Sequence
  Synthetic Construct
GWGIALLVLVCVLVA

SEQ ID NO: 227 - protein, 15 aa, Artificial Sequence
  Synthetic Construct
ALLVLVCVLVALAIV

SEQ ID NO: 228 - protein, 15 aa, Artificial Sequence
  Synthetic Construct
LVCVLVALAIVYLIA

SEQ ID NO: 229 - protein, 15 aa, Artificial Sequence
  Synthetic Construct
LVALAIVYLIALAVC

SEQ ID NO: 230 - protein, 15 aa, Artificial Sequence
  Synthetic Construct
AIVYLIALAVCQCRR

SEQ ID NO: 231 - protein, 15 aa, Artificial Sequence
  Synthetic Construct
LIALAVCQCRRKNYG

SEQ ID NO: 232 - protein, 15 aa, Artificial Sequence
  Synthetic Construct
AVCQCRRKNYGQLDI

SEQ ID NO: 233 - protein, 15 aa, Artificial Sequence
  Synthetic Construct
CRRKNYGQLDIFPAR

SEQ ID NO: 234 - protein, 15 aa, Artificial Sequence
  Synthetic Construct
NYGQLDIFPARDTYH

SEQ ID NO: 235 - protein, 15 aa, Artificial Sequence
  Synthetic Construct
LDIFPARDTYHPMSE

SEQ ID NO: 236 - protein, 15 aa, Artificial Sequence
  Synthetic Construct
PARDTYHPMSEYPTY

SEQ ID NO: 237 - protein, 15 aa, Artificial Sequence
  Synthetic Construct
TYHPMSEYPTYHTHG

SEQ ID NO: 238 - protein, 15 aa, Artificial Sequence
  Synthetic Construct
MSEYPTYHTHGRYVP

SEQ ID NO: 239 - protein, 15 aa, Artificial Sequence
  Synthetic Construct
PTYHTHGRYVPPSST

SEQ ID NO: 240 - protein, 15 aa, Artificial Sequence
  Synthetic Construct
THGRYVPPSSTDRSP

SEQ ID NO: 241 - protein, 15 aa, Artificial Sequence
  Synthetic Construct
YVPPSSTDRSPYEKV

SEQ ID NO: 242 - protein, 15 aa, Artificial Sequence
  Synthetic Construct
SSTDRSPYEKVSAGN

SEQ ID NO: 243 - protein, 15 aa, Artificial Sequence
  Synthetic Construct
RSPYEKVSAGNGGSS

SEQ ID NO: 244 - protein, 15 aa, Artificial Sequence
  Synthetic Construct
EKVSAGNGGSSLSYT

SEQ ID NO: 245 - protein, 15 aa, Artificial Sequence
  Synthetic Construct
AGNGGSSLSYTNPAV

SEQ ID NO: 246 - protein, 15 aa, Artificial Sequence
  Synthetic Construct
GSSLSYTNPAVAAAS

SEQ ID NO: 247 - protein, 15 aa, Artificial Sequence
  Synthetic Construct
LSYTNPAVAAASANL

SEQ ID NO: 248 - protein, 15 aa, Artificial Sequence
  Synthetic Construct
MASLPTARPLLGSCG

SEQ ID NO: 249 - protein, 15 aa, Artificial Sequence
  Synthetic Construct
TARPLLGSCGTPALG

SEQ ID NO: 250 - protein, 15 aa, Artificial Sequence
  Synthetic Construct
LLGSCGTPALGSLLF

SEQ ID NO: 251 - protein, 15 aa, Artificial Sequence
  Synthetic Construct
CGTPALGSLLFLLFS

SEQ ID NO: 252 - protein, 15 aa, Artificial Sequence
  Synthetic Construct
ALGSLLFLLFSLGWV

SEQ ID NO: 253 - protein, 15 aa, Artificial Sequence
  Synthetic Construct
LLFLLFSLGWVQPSR

SEQ ID NO: 254 - protein, 15 aa, Artificial Sequence
  Synthetic Construct
LFSLGWVQPSRTLAG

SEQ ID NO: 255 - protein, 15 aa, Artificial Sequence
  Synthetic Construct
GWVQPSRTLAGETGQ

SEQ ID NO: 256 - protein, 15 aa, Artificial Sequence
  Synthetic Construct
PSRTLAGETGQEAAP

SEQ ID NO: 257 - protein, 15 aa, Artificial Sequence
  Synthetic Construct
TLAGETGQEAAPLDG

SEQ ID NO: 258 - protein, 15 aa, Artificial Sequence
  Synthetic Construct
TGQEAAPLDGVLANP

SEQ ID NO: 259 - protein, 15 aa, Artificial Sequence
  Synthetic Construct
AAPLDGVLANPPNIS

SEQ ID NO: 260 - protein, 15 aa, Artificial Sequence
  Synthetic Construct
DGVLANPPNISSLSP

SEQ ID NO: 261 - protein, 15 aa, Artificial Sequence
  Synthetic Construct
ANPPNISSLSPRQLL

SEQ ID NO: 262 - protein, 15 aa, Artificial Sequence
  Synthetic Construct
NISSLSPRQLLGFPC

SEQ ID NO: 263 - protein, 15 aa, Artificial Sequence
  Synthetic Construct
LSPRQLLGFPCAEVS

SEQ ID NO: 264 - protein, 15 aa, Artificial Sequence
  Synthetic Construct
QLLGFPCAEVSGLST

SEQ ID NO: 265 - protein, 15 aa, Artificial Sequence
  Synthetic Construct
FPCAEVSGLSTERVR

SEQ ID NO: 266 - protein, 15 aa, Artificial Sequence
  Synthetic Construct
EVSGLSTERVRELAV

SEQ ID NO: 267 - protein, 15 aa, Artificial Sequence
  Synthetic Construct
LSTERVRELAVALAQ

SEQ ID NO: 268 - protein, 15 aa, Artificial Sequence
  Synthetic Construct
RVRELAVALAQKNVK

SEQ ID NO: 269 - protein, 15 aa, Artificial Sequence
  Synthetic Construct
LAVALAQKNVKLSTE

SEQ ID NO: 270 - protein, 15 aa, Artificial Sequence
  Synthetic Construct
LAQKNVKLSTEQLRC

SEQ ID NO: 271 - protein, 15 aa, Artificial Sequence
  Synthetic Construct
NVKLSTEQLRCLAHR

SEQ ID NO: 272 - protein, 15 aa, Artificial Sequence
  Synthetic Construct
STEQLRCLAHRLSEP

SEQ ID NO: 273 - protein, 15 aa, Artificial Sequence
  Synthetic Construct
LRCLAHRLSEPPEDL

SEQ ID NO: 274 - protein, 15 aa, Artificial Sequence
  Synthetic Construct
AHRLSEPPEDLDALP

SEQ ID NO: 275 - protein, 15 aa, Artificial Sequence
  Synthetic Construct
SEPPEDLDALPLDLL

SEQ ID NO: 276 - protein, 15 aa, Artificial Sequence
  Synthetic Construct
EDLDALPLDLLLFLN

SEQ ID NO: 277 - protein, 15 aa, Artificial Sequence
  Synthetic Construct
ALPLDLLLFLNPDAF

SEQ ID NO: 278 - protein, 15 aa, Artificial Sequence
  Synthetic Construct
DLLLFLNPDAFSGPQ

SEQ ID NO: 279 - protein, 15 aa, Artificial Sequence
  Synthetic Construct
FLNPDAFSGPQACTR

SEQ ID NO: 280 - protein, 15 aa, Artificial Sequence
  Synthetic Construct
DAFSGPQACTRFFSR

SEQ ID NO: 281 - protein, 15 aa, Artificial Sequence
  Synthetic Construct
GPQACTRFFSRITKA

SEQ ID NO: 282 - protein, 15 aa, Artificial Sequence
  Synthetic Construct
CTRFFSRITKANVDL

SEQ ID NO: 283 - protein, 15 aa, Artificial Sequence
  Synthetic Construct
FSRITKANVDLLPRG

SEQ ID NO: 284 - protein, 15 aa, Artificial Sequence
  Synthetic Construct
TKANVDLLPRGAPER

SEQ ID NO: 285 - protein, 15 aa, Artificial Sequence
  Synthetic Construct
VDLLPRGAPERQRLL

SEQ ID NO: 286 - protein, 15 aa, Artificial Sequence
  Synthetic Construct
PRGAPERQRLLPAAL

SEQ ID NO: 287 - protein, 15 aa, Artificial Sequence
  Synthetic Construct
PERQRLLPAALACWG

SEQ ID NO: 288 - protein, 15 aa, Artificial Sequence
  Synthetic Construct
RLLPAALACWGVRGS

SEQ ID NO: 289 - protein, 15 aa, Artificial Sequence
  Synthetic Construct
AALACWGVRGSLLSE

SEQ ID NO: 290 - protein, 15 aa, Artificial Sequence
  Synthetic Construct
CWGVRGSLLSEADVR

SEQ ID NO: 291 - protein, 15 aa, Artificial Sequence
  Synthetic Construct
RGSLLSEADVRALGG

SEQ ID NO: 292 - protein, 15 aa, Artificial Sequence
  Synthetic Construct
LSEADVRALGGLACD

SEQ ID NO: 293 - protein, 15 aa, Artificial Sequence
  Synthetic Construct
DVRALGGLACDLPGR

SEQ ID NO: 294 - protein, 15 aa, Artificial Sequence
  Synthetic Construct
LGGLACDLPGRFVAE

SEQ ID NO: 295 - protein, 15 aa, Artificial Sequence
  Synthetic Construct
ACDLPGRFVAESAEV

SEQ ID NO: 296 - protein, 15 aa, Artificial Sequence
  Synthetic Construct
PGRFVAESAEVLLPR

SEQ ID NO: 297 - protein, 15 aa, Artificial Sequence
  Synthetic Construct
VAESAEVLLPRLVSC

SEQ ID NO: 298 - protein, 15 aa, Artificial Sequence
  Synthetic Construct
AEVLLPRLVSCPGPL

SEQ ID NO: 299 - protein, 15 aa, Artificial Sequence
  Synthetic Construct
LPRLVSCPGPLDQDQ

SEQ ID NO: 300 - protein, 15 aa, Artificial Sequence
  Synthetic Construct
VSCPGPLDQDQQEAA

SEQ ID NO: 301 - protein, 15 aa, Artificial Sequence
  Synthetic Construct
GPLDQDQQEAARAAL

SEQ ID NO: 302 - protein, 15 aa, Artificial Sequence
  Synthetic Construct
QDQQEAARAALQGGG

SEQ ID NO: 303 - protein, 15 aa, Artificial Sequence
  Synthetic Construct
EAARAALQGGGPPYG

SEQ ID NO: 304 - protein, 15 aa, Artificial Sequence
  Synthetic Construct
AALQGGGPPYGPPST

SEQ ID NO: 305 - protein, 15 aa, Artificial Sequence
  Synthetic Construct
GGGPPYGPPSTWSVS

SEQ ID NO: 306 - protein, 15 aa, Artificial Sequence
  Synthetic Construct
PYGPPSTWSVSTMDA

SEQ ID NO: 307 - protein, 15 aa, Artificial Sequence
  Synthetic Construct
PSTWSVSTMDALRGL

SEQ ID NO: 308 - protein, 15 aa, Artificial Sequence
  Synthetic Construct
SVSTMDALRGLLPVL

SEQ ID NO: 309 - protein, 15 aa, Artificial Sequence
  Synthetic Construct
MDALRGLLPVLGQPI

SEQ ID NO: 310 - protein, 15 aa, Artificial Sequence
  Synthetic Construct
RGLLPVLGQPIIRSI

SEQ ID NO: 311 - protein, 15 aa, Artificial Sequence
  Synthetic Construct
PVLGQPIIRSIPQGI

SEQ ID NO: 312 - protein, 15 aa, Artificial Sequence
  Synthetic Construct
QPIIRSIPQGIVAAW

SEQ ID NO: 313 - protein, 15 aa, Artificial Sequence
  Synthetic Construct
RSIPQGIVAAWRQRS

SEQ ID NO: 314 - protein, 15 aa, Artificial Sequence
  Synthetic Construct
QGIVAAWRQRSSRDP

SEQ ID NO: 315 - protein, 15 aa, Artificial Sequence
  Synthetic Construct
AAWRQRSSRDPSWRQ

SEQ ID NO: 316 - protein, 15 aa, Artificial Sequence
  Synthetic Construct
QRSSRDPSWRQPERT

SEQ ID NO: 317 - protein, 15 aa, Artificial Sequence
  Synthetic Construct
RDPSWRQPERTILRP

SEQ ID NO: 318 - protein, 15 aa, Artificial Sequence
  Synthetic Construct
WRQPERTILRPRFRR

SEQ ID NO: 319 - protein, 15 aa, Artificial Sequence
  Synthetic Construct
ERTILRPRFRREVEK

SEQ ID NO: 320 - protein, 15 aa, Artificial Sequence
  Synthetic Construct
LRPRFRREVEKTACP

SEQ ID NO: 321 - protein, 15 aa, Artificial Sequence
  Synthetic Construct
FRREVEKTACPSGKK

SEQ ID NO: 322 - protein, 15 aa, Artificial Sequence
  Synthetic Construct
VEKTACPSGKKAREI

SEQ ID NO: 323 - protein, 15 aa, Artificial Sequence
  Synthetic Construct
ACPSGKKAREIDESL

SEQ ID NO: 324 - protein, 15 aa, Artificial Sequence
  Synthetic Construct
GKKAREIDESLIFYK

SEQ ID NO: 325 - protein, 15 aa, Artificial Sequence
  Synthetic Construct
REIDESLIFYKKWEL

SEQ ID NO: 326 - protein, 15 aa, Artificial Sequence
  Synthetic Construct
ESLIFYKKWELEACV

SEQ ID NO: 327 - protein, 15 aa, Artificial Sequence
  Synthetic Construct
FYKKWELEACVDAAL

SEQ ID NO: 328 - protein, 15 aa, Artificial Sequence
  Synthetic Construct
WELEACVDAALLATQ

SEQ ID NO: 329 - protein, 15 aa, Artificial Sequence
  Synthetic Construct
ACVDAALLATQMDRV

SEQ ID NO: 330 - protein, 15 aa, Artificial Sequence
  Synthetic Construct
AALLATQMDRVNAIP

SEQ ID NO: 331 - protein, 15 aa, Artificial Sequence
  Synthetic Construct
ATQMDRVNAIPFTYE

SEQ ID NO: 332 - protein, 15 aa, Artificial Sequence
  Synthetic Construct
DRVNAIPFTYEQLDV

SEQ ID NO: 333 - protein, 15 aa, Artificial Sequence
  Synthetic Construct
AIPFTYEQLDVLKHK

SEQ ID NO: 334 - protein, 15 aa, Artificial Sequence
  Synthetic Construct
TYEQLDVLKHKLDEL

SEQ ID NO: 335 - protein, 15 aa, Artificial Sequence
  Synthetic Construct
LDVLKHKLDELYPQG

SEQ ID NO: 336 - protein, 15 aa, Artificial Sequence
  Synthetic Construct
KHKLDELYPQGYPES

SEQ ID NO: 337 - protein, 15 aa, Artificial Sequence
  Synthetic Construct
DELYPQGYPESVIQH

SEQ ID NO: 338 - protein, 15 aa, Artificial Sequence
  Synthetic Construct
PQGYPESVIQHLGYL

SEQ ID NO: 339 - protein, 15 aa, Artificial Sequence
  Synthetic Construct
PESVIQHLGYLFLKM

SEQ ID NO: 340 - protein, 15 aa, Artificial Sequence
  Synthetic Construct
IQHLGYLFLKMSPED

SEQ ID NO: 341 - protein, 15 aa, Artificial Sequence
  Synthetic Construct
GYLFLKMSPEDIRKW

SEQ ID NO: 342 - protein, 15 aa, Artificial Sequence
  Synthetic Construct
LKMSPEDIRKWNVTS

SEQ ID NO: 343 - protein, 15 aa, Artificial Sequence
  Synthetic Construct
PEDIRKWNVTSLETL

SEQ ID NO: 344 - protein, 15 aa, Artificial Sequence
  Synthetic Construct
RKWNVTSLETLKALL

SEQ ID NO: 345 - protein, 15 aa, Artificial Sequence
  Synthetic Construct
VTSLETLKALLEVNK

SEQ ID NO: 346 - protein, 15 aa, Artificial Sequence
  Synthetic Construct
ETLKALLEVNKGHEM

SEQ ID NO: 347 - protein, 15 aa, Artificial Sequence
  Synthetic Construct
ALLEVNKGHEMSPQV

SEQ ID NO: 348 - protein, 15 aa, Artificial Sequence
  Synthetic Construct
VNKGHEMSPQVATLI

SEQ ID NO: 349 - protein, 15 aa, Artificial Sequence
  Synthetic Construct
HEMSPQVATLIDRFV

SEQ ID NO: 350 - protein, 15 aa, Artificial Sequence
  Synthetic Construct
PQVATLIDRFVKGRG

SEQ ID NO: 351 - protein, 15 aa, Artificial Sequence
  Synthetic Construct
TLIDRFVKGRGQLDK

SEQ ID NO: 352 - protein, 15 aa, Artificial Sequence
  Synthetic Construct
RFVKGRGQLDKDTLD

SEQ ID NO: 353 - protein, 15 aa, Artificial Sequence
  Synthetic Construct
GRGQLDKDTLDTLTA

SEQ ID NO: 354 - protein, 15 aa, Artificial Sequence
  Synthetic Construct
LDKDTLDTLTAFYPG

SEQ ID NO: 355 - protein, 15 aa, Artificial Sequence
  Synthetic Construct
TLDTLTAFYPGYLCS

SEQ ID NO: 356 - protein, 15 aa, Artificial Sequence
  Synthetic Construct
LTAFYPGYLCSLSPE

SEQ ID NO: 357 - protein, 15 aa, Artificial Sequence
  Synthetic Construct
YPGYLCSLSPEELSS

SEQ ID NO: 358 - protein, 15 aa, Artificial Sequence
  Synthetic Construct
LCSLSPEELSSVPPS

SEQ ID NO: 359 - protein, 15 aa, Artificial Sequence
  Synthetic Construct
SPEELSSVPPSSIWA

SEQ ID NO: 360 - protein, 15 aa, Artificial Sequence
  Synthetic Construct
LSSVPPSSIWAVRPQ

SEQ ID NO: 361 - protein, 15 aa, Artificial Sequence
  Synthetic Construct
PPSSIWAVRPQDLDT

SEQ ID NO: 362 - protein, 15 aa, Artificial Sequence
  Synthetic Construct
IWAVRPQDLDTCDPR

SEQ ID NO: 363 - protein, 15 aa, Artificial Sequence
  Synthetic Construct
RPQDLDTCDPRQLDV

SEQ ID NO: 364 - protein, 15 aa, Artificial Sequence
  Synthetic Construct
LDTCDPRQLDVLYPK

SEQ ID NO: 365 - protein, 15 aa, Artificial Sequence
  Synthetic Construct
DPRQLDVLYPKARLA

SEQ ID NO: 366 - protein, 15 aa, Artificial Sequence
  Synthetic Construct
LDVLYPKARLAFQNM

SEQ ID NO: 367 - protein, 15 aa, Artificial Sequence
  Synthetic Construct
YPKARLAFQNMNGSE

SEQ ID NO: 368 - protein, 15 aa, Artificial Sequence
  Synthetic Construct
RLAFQNMNGSEYFVK

SEQ ID NO: 369 - protein, 15 aa, Artificial Sequence
  Synthetic Construct
QNMNGSEYFVKIQSF

SEQ ID NO: 370 - protein, 15 aa, Artificial Sequence
  Synthetic Construct
GSEYFVKIQSFLGGA

SEQ ID NO: 371 - protein, 15 aa, Artificial Sequence
  Synthetic Construct
FVKIQSFLGGAPTED

SEQ ID NO: 372 - protein, 15 aa, Artificial Sequence
  Synthetic Construct
QSFLGGAPTEDLKAL

SEQ ID NO: 373 - protein, 15 aa, Artificial Sequence
  Synthetic Construct
GGAPTEDLKALSQQN

SEQ ID NO: 374 - protein, 15 aa, Artificial Sequence
  Synthetic Construct
TEDLKALSQQNVSMD

SEQ ID NO: 375 - protein, 15 aa, Artificial Sequence
  Synthetic Construct
KALSQQNVSMDLATF

SEQ ID NO: 376 - protein, 15 aa, Artificial Sequence
  Synthetic Construct
QQNVSMDLATFMKLR

SEQ ID NO: 377 - protein, 15 aa, Artificial Sequence
  Synthetic Construct
SMDLATFMKLRTDAV

SEQ ID NO: 378 - protein, 15 aa, Artificial Sequence
  Synthetic Construct
ATFMKLRTDAVLPLT

SEQ ID NO: 379 - protein, 15 aa, Artificial Sequence
  Synthetic Construct
KLRTDAVLPLTVAEV

SEQ ID NO: 380 - protein, 15 aa, Artificial Sequence
  Synthetic Construct
DAVLPLTVAEVQKLL

SEQ ID NO: 381 - protein, 15 aa, Artificial Sequence
  Synthetic Construct
PLTVAEVQKLLGPHV

SEQ ID NO: 382 - protein, 15 aa, Artificial Sequence
  Synthetic Construct
AEVQKLLGPHVEGLK

SEQ ID NO: 383 - protein, 15 aa, Artificial Sequence
  Synthetic Construct
KLLGPHVEGLKAEER

SEQ ID NO: 384 - protein, 15 aa, Artificial Sequence
  Synthetic Construct
PHVEGLKAEERHRPV

SEQ ID NO: 385 - protein, 15 aa, Artificial Sequence
  Synthetic Construct
GLKAEERHRPVRDWI

SEQ ID NO: 386 - protein, 15 aa, Artificial Sequence
  Synthetic Construct
EERHRPVRDWILRQR

SEQ ID NO: 387 - protein, 15 aa, Artificial Sequence
  Synthetic Construct
RPVRDWILRQRQDDL

SEQ ID NO: 388 - protein, 15 aa, Artificial Sequence
  Synthetic Construct
DWILRQRQDDLDTLG

SEQ ID NO: 389 - protein, 15 aa, Artificial Sequence
  Synthetic Construct
RQRQDDLDTLGLGLQ

SEQ ID NO: 390 - protein, 15 aa, Artificial Sequence
  Synthetic Construct
DDLDTLGLGLQGGIP

SEQ ID NO: 391 - protein, 15 aa, Artificial Sequence
  Synthetic Construct
TLGLGLQGGIPNGYL

SEQ ID NO: 392 - protein, 15 aa, Artificial Sequence
  Synthetic Construct
GLQGGIPNGYLVLDL

SEQ ID NO: 393 - protein, 15 aa, Artificial Sequence
  Synthetic Construct
GIPNGYLVLDLSMQE

SEQ ID NO: 394 - protein, 15 aa, Artificial Sequence
  Synthetic Construct
YLVLDLSMQEALSGT

SEQ ID NO: 395 - protein, 15 aa, Artificial Sequence
  Synthetic Construct
LDLSMQEALSGTPCL

SEQ ID NO: 396 - protein, 15 aa, Artificial Sequence
  Synthetic Construct
MQEALSGTPCLLGPG

SEQ ID NO: 397 - protein, 15 aa, Artificial Sequence
  Synthetic Construct
LSGTPCLLGPGPVLT

SEQ ID NO: 398 - protein, 15 aa, Artificial Sequence
  Synthetic Construct
PCLLGPGPVLTVLAL

SEQ ID NO: 399 - protein, 15 aa, Artificial Sequence
  Synthetic Construct
GPGPVLTVLALLLAS

SEQ ID NO: 400 - protein, 15 aa, Artificial Sequence
  Synthetic Construct
PVLTVLALLLASTLA

SEQ ID NO: 401 - protein, 15 aa, Artificial Sequence
  Synthetic Construct
RRGAAPEPERTPVGQ

SEQ ID NO: 402 - protein, 15 aa, Artificial Sequence
  Synthetic Construct
APEPERTPVGQGSWA

SEQ ID NO: 403 - protein, 15 aa, Artificial Sequence
  Synthetic Construct
ERTPVGQGSWAHPGR

SEQ ID NO: 404 - protein, 15 aa, Artificial Sequence
  Synthetic Construct
VGQGSWAHPGRTRGP

SEQ ID NO: 405 - protein, 15 aa, Artificial Sequence
  Synthetic Construct
SWAHPGRTRGPSDRG

SEQ ID NO: 406 - protein, 15 aa, Artificial Sequence
  Synthetic Construct
PGRTRGPSDRGFCVV

SEQ ID NO: 407 - protein, 15 aa, Artificial Sequence
  Synthetic Construct
RGPSDRGFCVVSPAR

SEQ ID NO: 408 - protein, 15 aa, Artificial Sequence
  Synthetic Construct
DRGFCVVSPARPAEE

SEQ ID NO: 409 - protein, 15 aa, Artificial Sequence
  Synthetic Construct
CVVSPARPAEEATSL

SEQ ID NO: 410 - protein, 15 aa, Artificial Sequence
  Synthetic Construct
PARPAEEATSLEGAL

SEQ ID NO: 411 - protein, 15 aa, Artificial Sequence
  Synthetic Construct
AEEATSLEGALSGTR

SEQ ID NO: 412 - protein, 15 aa, Artificial Sequence
  Synthetic Construct
TSLEGALSGTRHSHP

SEQ ID NO: 413 - protein, 15 aa, Artificial Sequence
  Synthetic Construct
GALSGTRHSHPSVGR

SEQ ID NO: 414 - protein, 15 aa, Artificial Sequence
  Synthetic Construct
GTRHSHPSVGRQHHA

SEQ ID NO: 415 - protein, 15 aa, Artificial Sequence
  Synthetic Construct
SHPSVGRQHHAGPPS

SEQ ID NO: 416 - protein, 15 aa, Artificial Sequence
  Synthetic Construct
VGRQHHAGPPSTSRP

SEQ ID NO: 417 - protein, 15 aa, Artificial Sequence
  Synthetic Construct
HHAGPPSTSRPPRPW

SEQ ID NO: 418 - protein, 15 aa, Artificial Sequence
  Synthetic Construct
PPSTSRPPRPWDTPC

SEQ ID NO: 419 - protein, 15 aa, Artificial Sequence
  Synthetic Construct
SRPPRPWDTPCPPVY

SEQ ID NO: 420 - protein, 15 aa, Artificial Sequence
  Synthetic Construct
RPWDTPCPPVYAETK

SEQ ID NO: 421 - protein, 15 aa, Artificial Sequence
  Synthetic Construct
TPCPPVYAETKHFLY

SEQ ID NO: 422 - protein, 15 aa, Artificial Sequence
  Synthetic Construct
PVYAETKHFLYSSGD

SEQ ID NO: 423 - protein, 15 aa, Artificial Sequence
  Synthetic Construct
ETKHFLYSSGDKEQL

SEQ ID NO: 424 - protein, 15 aa, Artificial Sequence
  Synthetic Construct
FLYSSGDKEQLRPSF

SEQ ID NO: 425 - protein, 15 aa, Artificial Sequence
  Synthetic Construct
SGDKEQLRPSFLLSS

SEQ ID NO: 426 - protein, 15 aa, Artificial Sequence
  Synthetic Construct
EQLRPSFLLSSLRPS

SEQ ID NO: 427 - protein, 15 aa, Artificial Sequence
  Synthetic Construct
PSFLLSSLRPSLTGA

SEQ ID NO: 428 - protein, 15 aa, Artificial Sequence
  Synthetic Construct
LSSLRPSLTGARRLV

SEQ ID NO: 429 - protein, 15 aa, Artificial Sequence
  Synthetic Construct
RPSLTGARRLVETIF

SEQ ID NO: 430 - protein, 15 aa, Artificial Sequence
  Synthetic Construct
TGARRLVETIFLGSR

SEQ ID NO: 431 - protein, 15 aa, Artificial Sequence
  Synthetic Construct
RLVETIFLGSRPWMP

SEQ ID NO: 432 - protein, 15 aa, Artificial Sequence
  Synthetic Construct
TIFLGSRPWMPGTPR

SEQ ID NO: 433 - protein, 15 aa, Artificial Sequence
  Synthetic Construct
GSRPWMPGTPRRLPR

SEQ ID NO: 434 - protein, 15 aa, Artificial Sequence
  Synthetic Construct
WMPGTPRRLPRLPQR

SEQ ID NO: 435 - protein, 15 aa, Artificial Sequence
  Synthetic Construct
TPRRLPRLPQRYWQM

SEQ ID NO: 436 - protein, 15 aa, Artificial Sequence
  Synthetic Construct
LPRLPQRYWQMRPLF

SEQ ID NO: 437 - protein, 15 aa, Artificial Sequence
  Synthetic Construct
PQRYWQMRPLFLELL

SEQ ID NO: 438 - protein, 15 aa, Artificial Sequence
  Synthetic Construct
WQMRPLFLELLGNHA

SEQ ID NO: 439 - protein, 15 aa, Artificial Sequence
  Synthetic Construct
PLFLELLGNHAQCPY

SEQ ID NO: 440 - protein, 15 aa, Artificial Sequence
  Synthetic Construct
ELLGNHAQCPYGVLL

SEQ ID NO: 441 - protein, 15 aa, Artificial Sequence
  Synthetic Construct
NHAQCPYGVLLKTHC

SEQ ID NO: 442 - protein, 15 aa, Artificial Sequence
  Synthetic Construct
CPYGVLLKTHCPLRA

SEQ ID NO: 443 - protein, 15 aa, Artificial Sequence
  Synthetic Construct
VLLKTHCPLRAAVTP

SEQ ID NO: 444 - protein, 15 aa, Artificial Sequence
  Synthetic Construct
THCPLRAAVTPAAGV

SEQ ID NO: 445 - protein, 15 aa, Artificial Sequence
  Synthetic Construct
LRAAVTPAAGVCARE

SEQ ID NO: 446 - protein, 15 aa, Artificial Sequence
  Synthetic Construct
VTPAAGVCAREKPQG

SEQ ID NO: 447 - protein, 15 aa, Artificial Sequence
  Synthetic Construct
AGVCAREKPQGSVAA

SEQ ID NO: 448 - protein, 15 aa, Artificial Sequence
  Synthetic Construct
AREKPQGSVAAPEEE

SEQ ID NO: 449 - protein, 15 aa, Artificial Sequence
  Synthetic Construct
PQGSVAAPEEEDTDP

SEQ ID NO: 450 - protein, 15 aa, Artificial Sequence
  Synthetic Construct
VAAPEEEDTDPRRLV

SEQ ID NO: 451 - protein, 15 aa, Artificial Sequence
  Synthetic Construct
EEEDTDPRRLVQLLR

SEQ ID NO: 452 - protein, 15 aa, Artificial Sequence
  Synthetic Construct
TDPRRLVQLLRQHSS

SEQ ID NO: 453 - protein, 15 aa, Artificial Sequence
  Synthetic Construct
RLVQLLRQHSSPWQV

SEQ ID NO: 454 - protein, 15 aa, Artificial Sequence
  Synthetic Construct
LLRQHSSPWQVYGFV

SEQ ID NO: 455 - protein, 15 aa, Artificial Sequence
  Synthetic Construct
HSSPWQVYGFVRACL

SEQ ID NO: 456 - protein, 15 aa, Artificial Sequence
  Synthetic Construct
WQVYGFVRACLRRLV

SEQ ID NO: 457 - protein, 15 aa, Artificial Sequence
  Synthetic Construct
GFVRACLRRLVPPGL

SEQ ID NO: 458 - protein, 15 aa, Artificial Sequence
  Synthetic Construct
ACLRRLVPPGLWGSR

SEQ ID NO: 459 - protein, 15 aa, Artificial Sequence
  Synthetic Construct
RLVPPGLWGSRHNER

SEQ ID NO: 460 - protein, 15 aa, Artificial Sequence
  Synthetic Construct
PGLWGSRHNERRFLR

SEQ ID NO: 461 - protein, 15 aa, Artificial Sequence
  Synthetic Construct
GSRHNERRFLRNTKK

SEQ ID NO: 462 - protein, 15 aa, Artificial Sequence
  Synthetic Construct
NERRFLRNTKKFISL

SEQ ID NO: 463 - protein, 15 aa, Artificial Sequence
  Synthetic Construct
FLRNTKKFISLGKHA

SEQ ID NO: 464 - protein, 15 aa, Artificial Sequence
  Synthetic Construct
TKKFISLGKHAKLSL

SEQ ID NO: 465 - protein, 15 aa, Artificial Sequence
  Synthetic Construct
ISLGKHAKLSLQELT

SEQ ID NO: 466 - protein, 15 aa, Artificial Sequence
  Synthetic Construct
KHAKLSLQELTWKMS

SEQ ID NO: 467 - protein, 15 aa, Artificial Sequence
  Synthetic Construct
LSLQELTWKMSVRDC

SEQ ID NO: 468 - protein, 15 aa, Artificial Sequence
  Synthetic Construct
ELTWKMSVRDCAWLR

SEQ ID NO: 469 - protein, 15 aa, Artificial Sequence
  Synthetic Construct
KMSVRDCAWLRRSPG

SEQ ID NO: 470 - protein, 15 aa, Artificial Sequence
  Synthetic Construct
RDCAWLRRSPGVGCV

SEQ ID NO: 471 - protein, 15 aa, Artificial Sequence
  Synthetic Construct
WLRRSPGVGCVPAAE

SEQ ID NO: 472 - protein, 15 aa, Artificial Sequence
  Synthetic Construct
SPGVGCVPAAEHRLR

SEQ ID NO: 473 - protein, 15 aa, Artificial Sequence
  Synthetic Construct
GCVPAAEHRLREEIL

SEQ ID NO: 474 - protein, 15 aa, Artificial Sequence
  Synthetic Construct
AAEHRLREEILAKFL

SEQ ID NO: 475 - protein, 15 aa, Artificial Sequence
  Synthetic Construct
RLREEILAKFLHWLM

SEQ ID NO: 476 - protein, 15 aa, Artificial Sequence
  Synthetic Construct
EILAKFLHWLMSVYV

SEQ ID NO: 477 - protein, 15 aa, Artificial Sequence
  Synthetic Construct
KFLHWLMSVYVVELL

SEQ ID NO: 478 - protein, 15 aa, Artificial Sequence
  Synthetic Construct
WLMSVYVVELLRSFF

SEQ ID NO: 479 - protein, 15 aa, Artificial Sequence
  Synthetic Construct
VYVVELLRSFFYVTE

SEQ ID NO: 480 - protein, 15 aa, Artificial Sequence
  Synthetic Construct
ELLRSFFYVTETTFQ

SEQ ID NO: 481 - protein, 15 aa, Artificial Sequence
  Synthetic Construct
SFFYVTETTFQKNRL

SEQ ID NO: 482 - protein, 15 aa, Artificial Sequence
  Synthetic Construct
VTETTFQKNRLFFYR

SEQ ID NO: 483 - protein, 15 aa, Artificial Sequence
  Synthetic Construct
TFQKNRLFFYRKSVW

SEQ ID NO: 484 - protein, 15 aa, Artificial Sequence
  Synthetic Construct
NRLFFYRKSVWSKLQ

SEQ ID NO: 485 - protein, 15 aa, Artificial Sequence
  Synthetic Construct
FYRKSVWSKLQSIGI

SEQ ID NO: 486 - protein, 15 aa, Artificial Sequence
  Synthetic Construct
SVWSKLQSIGIRQHL

SEQ ID NO: 487 - protein, 15 aa, Artificial Sequence
  Synthetic Construct
KLQSIGIRQHLKRVQ

SEQ ID NO: 488 - protein, 15 aa, Artificial Sequence
  Synthetic Construct
IGIRQHLKRVQLREL

SEQ ID NO: 489 - protein, 15 aa, Artificial Sequence
  Synthetic Construct
QHLKRVQLRELSEAE

SEQ ID NO: 490 - protein, 15 aa, Artificial Sequence
  Synthetic Construct
RVQLRELSEAEVRQH

SEQ ID NO: 491 - protein, 15 aa, Artificial Sequence
  Synthetic Construct
RELSEAEVRQHREAR

SEQ ID NO: 492 - protein, 15 aa, Artificial Sequence
  Synthetic Construct
EAEVRQHREARPALL

SEQ ID NO: 493 - protein, 15 aa, Artificial Sequence
  Synthetic Construct
RQHREARPALLTSRL

SEQ ID NO: 494 - protein, 15 aa, Artificial Sequence
  Synthetic Construct
EARPALLTSRLRFIP

SEQ ID NO: 495 - protein, 15 aa, Artificial Sequence
  Synthetic Construct
ALLTSRLRFIPKPDG

SEQ ID NO: 496 - protein, 15 aa, Artificial Sequence
  Synthetic Construct
SRLRFIPKPDGLRPI

SEQ ID NO: 497 - protein, 15 aa, Artificial Sequence
  Synthetic Construct
FIPKPDGLRPIVNMD

SEQ ID NO: 498 - protein, 15 aa, Artificial Sequence
  Synthetic Construct
PDGLRPIVNMDYVVG

SEQ ID NO: 499 - protein, 15 aa, Artificial Sequence
  Synthetic Construct
RPIVNMDYVVGARTF

SEQ ID NO: 500 - protein, 15 aa, Artificial Sequence
  Synthetic Construct
NMDYVVGARTFRREK

SEQ ID NO: 501 - protein, 15 aa, Artificial Sequence
  Synthetic Construct
VVGARTFRREKRAER

SEQ ID NO: 502 - protein, 15 aa, Artificial Sequence
  Synthetic Construct
RTFRREKRAERLTSR

SEQ ID NO: 503 - protein, 15 aa, Artificial Sequence
  Synthetic Construct
REKRAERLTSRVKAL

SEQ ID NO: 504 - protein, 15 aa, Artificial Sequence
  Synthetic Construct
AERLTSRVKALFSVL

SEQ ID NO: 505 - protein, 15 aa, Artificial Sequence
  Synthetic Construct
TSRVKALFSVLNYER

SEQ ID NO: 506 - protein, 15 aa, Artificial Sequence
  Synthetic Construct
KALFSVLNYERARRP

SEQ ID NO: 507 - protein, 15 aa, Artificial Sequence
  Synthetic Construct
SVLNYERARRPGLLG

SEQ ID NO: 508 - protein, 15 aa, Artificial Sequence
  Synthetic Construct
YERARRPGLLGASVL

SEQ ID NO: 509 - protein, 15 aa, Artificial Sequence
  Synthetic Construct
RRPGLLGASVLGLDD

SEQ ID NO: 510 - protein, 15 aa, Artificial Sequence
  Synthetic Construct
LLGASVLGLDDIHRA

SEQ ID NO: 511 - protein, 15 aa, Artificial Sequence
  Synthetic Construct
SVLGLDDIHRAWRTF

SEQ ID NO: 512 - protein, 15 aa, Artificial Sequence
  Synthetic Construct
LDDIHRAWRTFVLRV

SEQ ID NO: 513 - protein, 15 aa, Artificial Sequence
  Synthetic Construct
HRAWRTFVLRVRAQD

SEQ ID NO: 514 - protein, 15 aa, Artificial Sequence
  Synthetic Construct
RTFVLRVRAQDPPPE

SEQ ID NO: 515 - protein, 15 aa, Artificial Sequence
  Synthetic Construct
LRVRAQDPPPELYFV

SEQ ID NO: 516 - protein, 15 aa, Artificial Sequence
  Synthetic Construct
AQDPPPELYFVKVDV

SEQ ID NO: 517 - protein, 15 aa, Artificial Sequence
  Synthetic Construct
PPELYFVKVDVTGAY

SEQ ID NO: 518 - protein, 15 aa, Artificial Sequence
  Synthetic Construct
YFVKVDVTGAYDTIP

SEQ ID NO: 519 - protein, 15 aa, Artificial Sequence
  Synthetic Construct
VDVTGAYDTIPQDRL

SEQ ID NO: 520 - protein, 15 aa, Artificial Sequence
  Synthetic Construct
GAYDTIPQDRLTEVI

SEQ ID NO: 521 - protein, 15 aa, Artificial Sequence
  Synthetic Construct
TIPQDRLTEVIASII

SEQ ID NO: 522 - protein, 15 aa, Artificial Sequence
  Synthetic Construct
DRLTEVIASIIKPQN

SEQ ID NO: 523 - protein, 15 aa, Artificial Sequence
  Synthetic Construct
EVIASIIKPQNTYCV

SEQ ID NO: 524 - protein, 15 aa, Artificial Sequence
  Synthetic Construct
SIIKPQNTYCVRRYA

SEQ ID NO: 525 - protein, 15 aa, Artificial Sequence
  Synthetic Construct
PQNTYCVRRYAVVQK

SEQ ID NO: 526 - protein, 15 aa, Artificial Sequence
  Synthetic Construct
YCVRRYAVVQKAAHG

SEQ ID NO: 527 - protein, 15 aa, Artificial Sequence
  Synthetic Construct
RYAVVQKAAHGHVRK

SEQ ID NO: 528 - protein, 15 aa, Artificial Sequence
  Synthetic Construct
VQKAAHGHVRKAFKS

SEQ ID NO: 529 - protein, 15 aa, Artificial Sequence
  Synthetic Construct
AHGHVRKAFKSHVST

SEQ ID NO: 530 - protein, 15 aa, Artificial Sequence
  Synthetic Construct
VRKAFKSHVSTLTDL

SEQ ID NO: 531 - protein, 15 aa, Artificial Sequence
  Synthetic Construct
FKSHVSTLTDLQPYM

SEQ ID NO: 532 - protein, 15 aa, Artificial Sequence
  Synthetic Construct
VSTLTDLQPYMRQFV

SEQ ID NO: 533 - protein, 15 aa, Artificial Sequence
  Synthetic Construct
TDLQPYMRQFVAHLQ

SEQ ID NO: 534 - protein, 15 aa, Artificial Sequence
  Synthetic Construct
PYMRQFVAHLQETSP

SEQ ID NO: 535 - protein, 15 aa, Artificial Sequence
  Synthetic Construct
QFVAHLQETSPLRDA

SEQ ID NO: 536 - protein, 15 aa, Artificial Sequence
  Synthetic Construct
HLQETSPLRDAVVIE

SEQ ID NO: 537 - protein, 15 aa, Artificial Sequence
  Synthetic Construct
TSPLRDAVVIEQSSS

SEQ ID NO: 538 - protein, 15 aa, Artificial Sequence
  Synthetic Construct
RDAVVIEQSSSLNEA

SEQ ID NO: 539 - protein, 15 aa, Artificial Sequence
  Synthetic Construct
VIEQSSSLNEASSGL

SEQ ID NO: 540 - protein, 15 aa, Artificial Sequence
  Synthetic Construct
SSSLNEASSGLFDVF

SEQ ID NO: 541 - protein, 15 aa, Artificial Sequence
  Synthetic Construct
NEASSGLFDVFLRFM

SEQ ID NO: 542 - protein, 15 aa, Artificial Sequence
  Synthetic Construct
SGLFDVFLRFMCHHA

SEQ ID NO: 543 - protein, 15 aa, Artificial Sequence
  Synthetic Construct
DVFLRFMCHHAVRIR

SEQ ID NO: 544 - protein, 15 aa, Artificial Sequence
  Synthetic Construct
RFMCHHAVRIRGKSY

SEQ ID NO: 545 - protein, 15 aa, Artificial Sequence
  Synthetic Construct
HHAVRIRGKSYVQCQ

SEQ ID NO: 546 - protein, 15 aa, Artificial Sequence
  Synthetic Construct
RIRGKSYVQCQGIPQ

SEQ ID NO: 547 - protein, 15 aa, Artificial Sequence
  Synthetic Construct
KSYVQCQGIPQGSIL

SEQ ID NO: 548 - protein, 15 aa, Artificial Sequence
  Synthetic Construct
QCQGIPQGSILSTLL

SEQ ID NO: 549 - protein, 15 aa, Artificial Sequence
  Synthetic Construct
IPQGSILSTLLCSLC

SEQ ID NO: 550 - protein, 15 aa, Artificial Sequence
  Synthetic Construct
SILSTLLCSLCYGDM

SEQ ID NO: 551 - protein, 15 aa, Artificial Sequence
  Synthetic Construct
TLLCSLCYGDMENKL

SEQ ID NO: 552 - protein, 15 aa, Artificial Sequence
  Synthetic Construct
SLCYGDMENKLFAGI

SEQ ID NO: 553 - protein, 15 aa, Artificial Sequence
  Synthetic Construct
GDMENKLFAGIRRDG

SEQ ID NO: 554 - protein, 15 aa, Artificial Sequence
  Synthetic Construct
NKLFAGIRRDGLLLR

SEQ ID NO: 555 - protein, 15 aa, Artificial Sequence
  Synthetic Construct
AGIRRDGLLLRLVDD

SEQ ID NO: 556 - protein, 15 aa, Artificial Sequence
  Synthetic Construct
RDGLLLRLVDDFLLV

SEQ ID NO: 557 - protein, 15 aa, Artificial Sequence
  Synthetic Construct
LLRLVDDFLLVTPHL

SEQ ID NO: 558 - protein, 15 aa, Artificial Sequence
  Synthetic Construct
VDDFLLVTPHLTHAK

SEQ ID NO: 559 - protein, 15 aa, Artificial Sequence
  Synthetic Construct
LLVTPHLTHAKTFLR

SEQ ID NO: 560 - protein, 15 aa, Artificial Sequence
  Synthetic Construct
PHLTHAKTFLRTLVR

SEQ ID NO: 561 - protein, 15 aa, Artificial Sequence
  Synthetic Construct
HAKTFLRTLVRGVPE

SEQ ID NO: 562 - protein, 15 aa, Artificial Sequence
  Synthetic Construct
FLRTLVRGVPEYGCV

SEQ ID NO: 563 - protein, 15 aa, Artificial Sequence
  Synthetic Construct
LVRGVPEYGCVVNLR

SEQ ID NO: 564 - protein, 15 aa, Artificial Sequence
  Synthetic Construct
VPEYGCVVNLRKTVV

SEQ ID NO: 565 - protein, 15 aa, Artificial Sequence
  Synthetic Construct
GCVVNLRKTVVNFPV

SEQ ID NO: 566 - protein, 15 aa, Artificial Sequence
  Synthetic Construct
NLRKTVVNFPVEDEA

SEQ ID NO: 567 - protein, 15 aa, Artificial Sequence
  Synthetic Construct
TVVNFPVEDEALGGT

SEQ ID NO: 568 - protein, 15 aa, Artificial Sequence
  Synthetic Construct
FPVEDEALGGTAFVQ

SEQ ID NO: 569 - protein, 15 aa, Artificial Sequence
  Synthetic Construct
DEALGGTAFVQMPAH

SEQ ID NO: 570 - protein, 15 aa, Artificial Sequence
  Synthetic Construct
GGTAFVQMPAHGLFP

SEQ ID NO: 571 - protein, 15 aa, Artificial Sequence
  Synthetic Construct
FVQMPAHGLFPWCGL

SEQ ID NO: 572 - protein, 15 aa, Artificial Sequence
  Synthetic Construct
PAHGLFPWCGLLLDT

SEQ ID NO: 573 - protein, 15 aa, Artificial Sequence
  Synthetic Construct
LFPWCGLLLDTRTLE

SEQ ID NO: 574 - protein, 15 aa, Artificial Sequence
  Synthetic Construct
CGLLLDTRTLEVQSD

SEQ ID NO: 575 - protein, 15 aa, Artificial Sequence
  Synthetic Construct
LDTRTLEVQSDYSSY

SEQ ID NO: 576 - protein, 15 aa, Artificial Sequence
  Synthetic Construct
TLEVQSDYSSYARTS

SEQ ID NO: 577 - protein, 15 aa, Artificial Sequence
  Synthetic Construct
QSDYSSYARTSIRAS

SEQ ID NO: 578 - protein, 15 aa, Artificial Sequence
  Synthetic Construct
SSYARTSIRASLTFN

SEQ ID NO: 579 - protein, 15 aa, Artificial Sequence
  Synthetic Construct
RTSIRASLTFNRGFK

SEQ ID NO: 580 - protein, 15 aa, Artificial Sequence
  Synthetic Construct
RASLTFNRGFKAGRN

SEQ ID NO: 581 - protein, 15 aa, Artificial Sequence
  Synthetic Construct
TFNRGFKAGRNMRRK

SEQ ID NO: 582 - protein, 15 aa, Artificial Sequence
  Synthetic Construct
GFKAGRNMRRKLFGV

SEQ ID NO: 583 - protein, 15 aa, Artificial Sequence
  Synthetic Construct
GRNMRRKLFGVLRLK

SEQ ID NO: 584 - protein, 15 aa, Artificial Sequence
  Synthetic Construct
RRKLFGVLRLKCHSL

SEQ ID NO: 585 - protein, 15 aa, Artificial Sequence
  Synthetic Construct
FGVLRLKCHSLFLDL

SEQ ID NO: 586 - protein, 15 aa, Artificial Sequence
  Synthetic Construct
RLKCHSLFLDLQVNS

SEQ ID NO: 587 - protein, 15 aa, Artificial Sequence
  Synthetic Construct
HSLFLDLQVNSLQTV

SEQ ID NO: 588 - protein, 15 aa, Artificial Sequence
  Synthetic Construct
LDLQVNSLQTVCTNI

SEQ ID NO: 589 - protein, 15 aa, Artificial Sequence
  Synthetic Construct
VNSLQTVCTNIYKIL

SEQ ID NO: 590 - protein, 15 aa, Artificial Sequence
  Synthetic Construct
QTVCTNIYKILLLQA

SEQ ID NO: 591 - protein, 15 aa, Artificial Sequence
  Synthetic Construct
TNIYKILLLQAYRFH

SEQ ID NO: 592 - protein, 15 aa, Artificial Sequence
  Synthetic Construct
KILLLQAYRFHACVL

SEQ ID NO: 593 - protein, 15 aa, Artificial Sequence
  Synthetic Construct
LQAYRFHACVLQLPF

SEQ ID NO: 594 - protein, 15 aa, Artificial Sequence
  Synthetic Construct
RFHACVLQLPFHQQV

SEQ ID NO: 595 - protein, 15 aa, Artificial Sequence
  Synthetic Construct
CVLQLPFHQQVWKNP

SEQ ID NO: 596 - protein, 15 aa, Artificial Sequence
  Synthetic Construct
LPFHQQVWKNPTFFL

SEQ ID NO: 597 - protein, 15 aa, Artificial Sequence
  Synthetic Construct
QQVWKNPTFFLRVIS

SEQ ID NO: 598 - protein, 15 aa, Artificial Sequence
  Synthetic Construct
KNPTFFLRVISDTAS

SEQ ID NO: 599 - protein, 15 aa, Artificial Sequence
  Synthetic Construct
FFLRVISDTASLCYS

SEQ ID NO: 600 - protein, 15 aa, Artificial Sequence
  Synthetic Construct
VISDTASLCYSILKA

SEQ ID NO: 601 - protein, 15 aa, Artificial Sequence
  Synthetic Construct
TASLCYSILKAKNAG

SEQ ID NO: 602 - protein, 15 aa, Artificial Sequence
  Synthetic Construct
CYSILKAKNAGMSLG

SEQ ID NO: 603 - protein, 15 aa, Artificial Sequence
  Synthetic Construct
LKAKNAGMSLGAKGA

SEQ ID NO: 604 - protein, 15 aa, Artificial Sequence
  Synthetic Construct
NAGMSLGAKGAAGPL

SEQ ID NO: 605 - protein, 15 aa, Artificial Sequence
  Synthetic Construct
SLGAKGAAGPLPSEA

SEQ ID NO: 606 - protein, 15 aa, Artificial Sequence
  Synthetic Construct
KGAAGPLPSEAVQWL

SEQ ID NO: 607 - protein, 15 aa, Artificial Sequence
  Synthetic Construct
GPLPSEAVQWLCHQA

SEQ ID NO: 608 - protein, 15 aa, Artificial Sequence
  Synthetic Construct
SEAVQWLCHQAFLLK

SEQ ID NO: 609 - protein, 15 aa, Artificial Sequence
  Synthetic Construct
QWLCHQAFLLKLTRH

SEQ ID NO: 610 - protein, 15 aa, Artificial Sequence
  Synthetic Construct
HQAFLLKLTRHRVTY

SEQ ID NO: 611 - protein, 15 aa, Artificial Sequence
  Synthetic Construct
LLKLTRHRVTYVPLL

SEQ ID NO: 612 - protein, 15 aa, Artificial Sequence
  Synthetic Construct
TRHRVTYVPLLGSLR

SEQ ID NO: 613 - protein, 15 aa, Artificial Sequence
  Synthetic Construct
VTYVPLLGSLRTAQT

SEQ ID NO: 614 - protein, 15 aa, Artificial Sequence
  Synthetic Construct
PLLGSLRTAQTQLSR

SEQ ID NO: 615 - protein, 15 aa, Artificial Sequence
  Synthetic Construct
SLRTAQTQLSRKLPG

SEQ ID NO: 616 - protein, 15 aa, Artificial Sequence
  Synthetic Construct
AQTQLSRKLPGTTLT

SEQ ID NO: 617 - protein, 15 aa, Artificial Sequence
  Synthetic Construct
LSRKLPGTTLTALEA

SEQ ID NO: 618 - protein, 15 aa, Artificial Sequence
  Synthetic Construct
LPGTTLTALEAAANP

SEQ ID NO: 619 - protein, 15 aa, Artificial Sequence
  Synthetic Construct
TLTALEAAANPALPS

SEQ ID NO: 620 - protein, 15 aa, Artificial Sequence
  Synthetic Construct
LEAAANPALPSDFKT

SEQ ID NO: 621 - protein, 15 aa, Artificial Sequence
  Synthetic Construct
AANPALPSDFKTILD

SEQ ID NO: 622 - protein, 10 aa, Artificial Sequence
  Synthetic Construct
STLTDLQPYM

SEQ ID NO: 623 - protein, 10 aa, Artificial Sequence
  Synthetic Construct
LNEASSGLFD

SEQ ID NO: 624 - protein, 10 aa, Artificial Sequence
  Synthetic Construct
LRPVPGDPAG

SEQ ID NO: 625 - protein, 10 aa, Artificial Sequence
  Synthetic Construct
AGRAAPAFGG

SEQ ID NO: 626 - protein, 10 aa, Artificial Sequence
  Synthetic Construct
STLTDLQPYM

SEQ ID NO: 627 - protein, 10 aa, Artificial Sequence
  Synthetic Construct
LNEASSGLFD

SEQ ID NO: 628 - protein, 10 aa, Artificial Sequence
  Synthetic Construct
LRPVPGDPAG

SEQ ID NO: 629 - protein, 10 aa, Artificial Sequence
  Synthetic Construct
AGRAAPAFGG

SEQ ID NO: 630 - DNA, 24 bp, Artificial Sequence
  Synthetic Construct
tcgtcgttttgtcgttttgtcgtt

SEQ ID NO: 631 - DNA, 21 bp, Artificial Sequence
  Synthetic Construct
tcgtcgtttttcggtgctttt

SEQ ID NO: 632 - DNA, 21 bp, Artificial Sequence
  Synthetic Construct
tcgtcgtttttcggtcgtttt

SEQ ID NO: 633 - protein, 20 aa, Artificial Sequence
  Synthetic Construct
QTLNFDLLKLAGDVESNPGP

SEQ ID NO: 634 - protein, 18 aa, Artificial Sequence
  Synthetic Construct
EGRGSLLTCGDVEENPGP

SEQ ID NO: 635 - protein, 20 aa, Artificial Sequence
  Synthetic Construct
HYAGYFADLLIHDIETNPGP

SEQ ID NO: 636 - protein, 20 aa, Artificial Sequence
  Synthetic Construct
QCTNYALLKLAGDVESNPGP

SEQ ID NO: 637 - protein, 25 aa, Artificial Sequence
  Synthetic Construct
TILSEGATNFSLLKLAGDVELNPGP

SEQ ID NO: 638 - protein, 19 aa, Artificial Sequence
  Synthetic Construct
ATNFSLLKQAGDVEENPGP

The invention claimed is:

1. A multi-antigen construct, comprising: (a) at least one nucleotide sequence encoding an immunogenic mucin 1 (MUC1) polypeptide; (b) at least one nucleotide sequence encoding an immunogenic mesothelin (MSLN) polypeptide; and (c) at least one nucleotide sequence encoding an immunogenic telomerase reverse transcriptase (TERT) polypeptide, wherein the immunogenic MUC1 polypeptide comprises an amino acid sequence selected from the group consisting of:
   (i) the amino acid sequence of SEQ ID NO:8;
   (ii) an amino acid sequence comprising amino acids 4-537 of SEQ ID NO:8;
   (iii) an amino acid sequence comprising amino acids 24-537 of SEQ ID NO:8;
   (iv) the amino acid sequence of SEQ ID NO:16;
   (v) an amino acid sequence comprising amino acids 4-517 of SEQ ID NO:16; and
   (vi) an amino acid sequence comprising amino acids 4-517 of SEQ ID NO:16 with the proviso that the amino acid at position 513 is T.

2. The multi-antigen construct of claim 1, wherein the immunogenic MSLN polypeptide comprises an amino acid sequence selected from the group consisting of:
   (i) an amino acid sequence comprising amino acids 37-597 of the amino acid sequence of SEQ ID NO:2;
   (ii) an amino acid sequence consisting of amino acids 37-597 of the amino acid sequence of SEQ ID NO:2;
   (iii) the amino acid sequence of SEQ ID NO:6; and
   (iv) an amino acid sequence comprising amino acids 4-564 of the amino acid sequence of SEQ ID NO:6.

3. The multi-antigen construct of claim 1, wherein the immunogenic TERT polypeptide comprises an amino acid sequence selected from the group consisting of:
   (i) the amino acid sequence of SEQ ID NO:10;
   (ii) the amino acid sequence of SEQ ID NO:12;
   (iii) the amino acid sequence of SEQ ID NO:14;
   (iv) an amino acid sequence comprising amino acids 2-892 of SEQ ID NO:10;
   (v) an amino acid sequence comprising amino acids 4-591 of SEQ ID NO:12; and
   (vi) an amino acid sequence comprising amino acids 3-789 of SEQ ID NO:14.

4. The multi-antigen construct of claim 3, wherein:
(i) the immunogenic MUC1 polypeptide comprises the amino acid sequence selected from the group consisting of:
(1) the amino acid sequence of SEQ ID NO:8;
(2) an amino acid sequence comprising amino acids 4-537 of SEQ ID NO:8;
(3) an amino acid sequence comprising amino acids 24-537 of SEQ ID NO:8;
(4) the amino acid sequence of SEQ ID NO:16;
(5) an amino acid sequence comprising amino acids 4-517 of SEQ ID NO:16; and
(6) an amino acid sequence comprising amino acids 4-517 of SEQ ID NO:16 with the proviso that the amino acid at position 513 is T; and
(ii) the immunogenic MSLN polypeptide comprises an amino acid sequence selected from the group consisting of:
(1) an amino acid sequence comprising amino acids 37-597 of SEQ ID NO:2;
(2) an amino acid sequence consisting of amino acids 37-597 of SEQ ID NO:2;
(3) the amino acid sequence of SEQ ID NO:6; and
(4) an amino acid sequence comprising amino acids 4-564 of SEQ ID NO:6.

5. A multi-antigen construct, comprising: (a) at least one nucleotide sequence encoding an immunogenic MUC1 polypeptide; (b) at least one nucleotide sequence encoding an immunogenic MSLN polypeptide; and (c) at least one nucleotide sequence encoding an immunogenic TERT polypeptide, wherein the nucleotide sequence encoding the immunogenic MUC1 polypeptide is selected from the group consisting of:
(i) the nucleotide sequence of SEQ ID NO:7;
(ii) a nucleotide sequence comprising nucleotides 10-1611 of SEQ ID NO:7;
(iii) the nucleotide sequence of SEQ ID NO:15;
(iv) a nucleotide sequence comprising nucleotides 10-1551 of SEQ ID NO:15; and
(v) a degenerate variant of any of the nucleotide sequences (i)-(iv).

6. The multi-antigen construct of claim 1, wherein the nucleotide sequence encoding the immunogenic MSLN polypeptide is selected from the group consisting of:
(i) the nucleotide sequence of SEQ ID NO:5;
(ii) a nucleotide sequence comprising nucleotides 10-1692 of SEQ ID NO:5; and
(iii) a degenerate variant of (1) the nucleotide sequence of SEQ ID NO:5 or (2) a nucleotide sequence comprising nucleotides 10-1692 of SEQ ID NO:5.

7. The multi-antigen construct of claim 1, wherein the nucleotide sequence encoding the immunogenic TERT polypeptide is selected from the group consisting of:
(i) the nucleotide sequence of SEQ ID NO:9;
(ii) a nucleotide sequence comprising nucleotides 4-2679 of SEQ ID NO:9;
(iii) the nucleotide sequence of SEQ ID NO:11;
(iv) a nucleotide sequence comprising nucleotides 10-1782 of SEQ ID NO:11;
(v) the nucleotide sequence of SEQ ID NO:13;
(vi) a nucleotide sequence comprising nucleotides 7-2373 of SEQ ID NO:13; and
(vii) a degenerate variant of any of the nucleotide sequences (i)-(vi).

8. A multi-antigen construct, which comprises: (I) at least one nucleotide sequence encoding an immunogenic MUC1 polypeptide; (II) at least one nucleotide sequence encoding an immunogenic MSLN polypeptide; and (III) at least one nucleotide sequence encoding an immunogenic TERT polypeptide, and has a structure of formula (VIII):

$$\text{TAA1-SPACER1-TAA2-SPACER2-TAA3} \qquad \text{(VIII)}$$

wherein in formula (VIII):
(a) TAA1, TAA2, and TAA3 are each a nucleotide sequence encoding an immunogenic tumor-associated antigen (TAA) polypeptide selected from the group consisting of an immunogenic MUC1 polypeptide, an immunogenic MSLN polypeptide, and an immunogenic TERT polypeptide, wherein TAA1, TAA2, and TAA3 encode different immunogenic TAA polypeptides; and
(b) SPACER1 and SPACER2 are each a spacer nucleotide sequence and may be the same or different, and
wherein;
(i) the nucleotide sequence encoding the immunogenic MUC1 polypeptide is selected from the group consisting of:
(1) the nucleotide sequence of SEQ ID NO:7;
(2) a nucleotide sequence comprising nucleotides 10-1611 of SEQ ID NO:7;
(3) the nucleotide sequence of SEQ ID NO:15;
(4) a nucleotide sequence comprising nucleotides 10-1551 of SEQ ID NO:15; and
(5) a degenerate variant of any of: the nucleotide sequence of SEQ ID NO:7; a nucleotide sequence comprising nucleotides 10-1611 of SEQ ID NO:7; the nucleotide sequence of SEQ ID NO:15; or a nucleotide sequence comprising nucleotides 10-1551 of SEQ ID NO:15;
(ii) the nucleotide sequence encoding the immunogenic MSLN polypeptide is selected from the group consisting of:
(1) the nucleotide sequence of SEQ ID NO:5;
(2) a nucleotide sequence comprising nucleotides 10-1692 of SEQ ID NO:5; and
(3) a degenerate variant of: the nucleotide sequence of SEQ ID NO:5; or a nucleotide sequence comprising nucleotides 10-1692 of SEQ ID NO:5; and
(iii) the nucleotide sequence encoding the immunogenic TERT polypeptide is selected from the group consisting of:
(1) the nucleotide sequence of SEQ ID N0:9;
(2) a nucleotide sequence comprising nucleotides 4-2679 of SEQ ID NO:9;
(3) the nucleotide sequence of SEQ ID NO:11;
(4) a nucleotide sequence comprising nucleotides 10-1782 of SEQ ID NO:11;
(5) the nucleotide sequence of SEQ ID NO:13;
(6) a nucleotide sequence comprising nucleotides 7-2373 of SEQ ID NO:13; and
(7) a degenerate variant of any of: the nucleotide sequence of SEQ ID NO:9; a nucleotide sequence comprising nucleotides 4-2679 of SEQ ID NO:9; the nucleotide sequence of SEQ ID NO:11; a nucleotide sequence comprising nucleotides 10-1782 of SEQ ID NO:11; the nucleotide sequence of SEQ ID NO:13; or a nucleotide sequence comprising nucleotides 7-2373 of SEQ ID NO:13.

9. A multi-antigen construct, which comprises a nucleotide sequence encoding the amino acid sequence of SEQ ID NO:44, 46, 48, 50, 52, 54, 56, 58, 60, 62, 64, or 66.

10. The multi-antigen construct of claim 9, which comprises a nucleotide sequence encoding the amino acid sequence of SEQ ID NO:44, 46, 48, or 50.

11. A multi-antigen construct, which comprises a nucleotide sequence encoding the amino acid sequence of SEQ ID NO:44.

12. A multi-antigen construct, which comprises the nucleotide sequence of SEQ ID NO:43, 45, 47, 49, 51, 53, 55, 57, 59, 61, 63, or 65, or a degenerate variant of the nucleotide sequence of SEQ ID NO: 43, 45, 47, 49, 51, 53, 55, 57, 59, 61, 63, or 65.

13. The multi-antigen construct of claim 12, which comprises the nucleotide sequence of SEQ ID NO:43, 45, 47, or 49, or a degenerate variant of the nucleotide sequence of SEQ ID NO: 43, 45, 47, or 49.

14. A multi-antigen construct, which comprises the nucleotide sequence of SEQ ID NO:43 or a degenerate variant of the nucleotide sequence of SEQ ID NO:43.

15. A vector comprising a multi-antigen construct of claim 1.

16. A composition comprising a multi-antigen construct of claim 1.

17. A pharmaceutical composition comprising: (i) a multi-antigen construct of claim 1; and (ii) a pharmaceutically acceptable carrier.

18. The multi-antigen construct of claim 8, wherein:
  (i) the nucleotide sequence encoding the immunogenic MUC1 polypeptide is selected from the group consisting of:
    (1) the nucleotide sequence of SEQ ID NO:7;
    (2) a nucleotide sequence comprising nucleotides 10-1611 of SEQ ID NO:7; and
    (3) a degenerate variant of: the nucleotide sequence of SEQ ID NO:7; or a nucleotide sequence comprising nucleotides 10-1611 of SEQ ID NO:7;
  (ii) the nucleotide sequence encoding the immunogenic MSLN polypeptide is selected from the group consisting of:
    (1) the nucleotide sequence of SEQ ID N0:5;
    (2) a nucleotide sequence comprising nucleotides 10-1692 of SEQ ID NO:5; and
    (3) a degenerate variant of: the nucleotide sequence of SEQ ID NO:5; or a nucleotide sequence comprising nucleotides 10-1692 of SEQ ID NO:5; and
  (iii) the nucleotide sequence encoding the immunogenic TERT polypeptide is selected from the group consisting of:
    (1) the nucleotide sequence of SEQ ID N0:9;
    (2) a nucleotide sequence comprising nucleotides 4-2679 of SEQ ID NO:9;
    (3) a degenerate variant of: the nucleotide sequence of SEQ ID NO:9; or a nucleotide sequence comprising nucleotides 4-2679 of SEQ ID NO:9.

19. A multi-antigen construct, which comprises: (I) at least one nucleotide sequence encoding an immunogenic MUC1 polypeptide; (II) at least one nucleotide sequence encoding an immunogenic MSLN polypeptide; and (III) at least one nucleotide sequence encoding an immunogenic TERT polypeptide, and has a structure of formula (VIII):

TAA1-SPACER1-TAA2-SPACER2-TAA3  (VIII)

wherein in formula (VIII): (i) SPACER1 and SPACER2 are each a spacer nucleotide sequence encoding a 2A peptide selected from foot-and-mouth disease virus 2A peptide (FMD2A), equine rhinitis A virus 2A peptide (ERA2A), equine rhinitis B virus 2A peptide (ERB2A), encephalomyocarditis virus 2A peptide (EMC2A), porcine teschovirus 2A peptide (PT2A), or Thosea asigna virus 2A peptide (T2A), and (ii) TAA1, TAA2, and TAA3 are each a nucleotide sequence encoding an immunogenic tumor-associated antigen (TAA) polypeptide selected from the group consisting of an immunogenic MUC1 polypeptide, an immunogenic MSLN polypeptide, and an immunogenic TERT polypeptide, wherein TAA1, TAA2, and TAA3 encode different immunogenic TAA polypeptides; and
wherein the immunogenic MUC1 polypeptide comprises an amino acid sequence selected from the group consisting of:
  (i) the amino acid sequence of SEQ ID NO:8;
  (ii) an amino acid sequence comprising amino acids 4-537 of SEQ ID NO:8;
  (iii) an amino acid sequence comprising amino acids 24-537 of SEQ ID NO:8;
  (iv) the amino acid sequence of SEQ ID NO:16;
  (v) an amino acid sequence comprising amino acids 4-517 of SEQ ID NO:16; and
  (vi) an amino acid sequence comprising amino acids 4-517 of SEQ ID NO:16 with the proviso that the amino acid at position 513 is T.

20. The multi-antigen construct of claim 19, wherein the 2A peptide is selected from ERB2A, EMC2A, or T2A.

21. The multi-antigen construct of claim 19, wherein the immunogenic MSLN polypeptide comprises an amino acid sequence selected from the group consisting of:
  (i) the amino acid sequence of SEQ ID NO:2;
  (ii) an amino acid sequence comprising amino acids 37-597 of the amino acid sequence of SEQ ID NO:2;
  (iii) the amino acid sequence of SEQ ID NO:6; and
  (iv) an amino acid sequence comprising amino acids 4-564 of the amino acid sequence of SEQ ID NO:6.

22. The multi-antigen construct of claim 19, wherein the immunogenic TERT polypeptide comprises an amino acid sequence selected from the group consisting of:
  (i) the amino acid sequence of SEQ ID NO:10;
  (ii) the amino acid sequence of SEQ ID NO:12;
  (iii) the amino acid sequence of SEQ ID NO:14;
  (iv) an amino acid sequence comprising amino acids 2-892 of SEQ ID NO:10;
  (v) an amino acid sequence comprising amino acids 4-591 of SEQ ID NO:12; and
  (vi) an amino acid sequence comprising amino acids 3-789 of SEQ ID NO:14.

23. The multi-antigen construct of claim 20, wherein the immunogenic MSLN polypeptide comprises an amino acid sequence selected from the group consisting of:
  (i) the amino acid sequence of SEQ ID NO:2;
  (ii) an amino acid sequence comprising amino acids 37-597 of the amino acid sequence of SEQ ID NO:2;
  (iii) the amino acid sequence of SEQ ID NO:6; and
  (iv) an amino acid sequence comprising amino acids 4-564 of the amino acid sequence of SEQ ID NO:6.

24. The multi-antigen construct of claim 20, wherein the immunogenic TERT polypeptide comprises an amino acid sequence selected from the group consisting of:
  (i) the amino acid sequence of SEQ ID NO:10;
  (ii) the amino acid sequence of SEQ ID NO:12;
  (iii) the amino acid sequence of SEQ ID NO:14;
  (iv) an amino acid sequence comprising amino acids 2-892 of SEQ ID NO:10;
  (v) an amino acid sequence comprising amino acids 4-591 of SEQ ID NO:12; and
  (vi) an amino acid sequence comprising amino acids 3-789 of SEQ ID NO:14.

25. The multi-antigen construct of claim 21, wherein the immunogenic TERT polypeptide comprises an amino acid sequence selected from the group consisting of:

(i) the amino acid sequence of SEQ ID NO:10;
(ii) the amino acid sequence of SEQ ID NO:12;
(iii) the amino acid sequence of SEQ ID NO:14;
(iv) an amino acid sequence comprising amino acids 2-892 of SEQ ID NO:10;
(v) an amino acid sequence comprising amino acids 4-591 of SEQ ID NO:12; and
(vi) an amino acid sequence comprising amino acids 3-789 of SEQ ID NO:14.

26. A multi-antigen construct, which comprises: (I) at least one nucleotide sequence encoding an immunogenic MUC1 polypeptide; (II) at least one nucleotide sequence encoding an immunogenic MSLN polypeptide; and (III) at least one nucleotide sequence encoding an immunogenic TERT polypeptide, and has a structure of formula (VIII):

TAA1-SPACER1-TAA2-SPACER2-TAA3     (VIII)

wherein in formula (VIII):
(a) TAA1, TAA2, and TAA3 are each a nucleotide sequence encoding an immunogenic TAA polypeptide selected from the group consisting of an immunogenic MUC1 polypeptide, an immunogenic MSLN polypeptide, and an immunogenic TERT polypeptide, wherein TAA1, TAA2, and TAA3 encode different immunogenic TAA polypeptides; and
(b) SPACER1 and SPACER2 are each a spacer nucleotide sequence and may be the same or different,
and wherein:
(i) the immunogenic MUC1 polypeptide comprises the amino acid sequence selected from the group consisting of:
(1) the amino acid sequence of SEQ ID NO:8;
(2) an amino acid sequence comprising amino acids 4-537 of SEQ ID NO:8;
(3) an amino acid sequence comprising amino acids 24-537 of SEQ ID NO:8;
(4) the amino acid sequence of SEQ ID NO:16;
(5) an amino acid sequence comprising amino acids 4-517 of SEQ ID NO:16; and
(6) an amino acid sequence comprising amino acids 4-517 of SEQ ID NO:16 with the proviso that the amino acid at position 513 is T;
(ii) the immunogenic MSLN polypeptide comprises an amino acid sequence selected from the group consisting of:
(1) an amino acid sequence comprising amino acids 37-597 of SEQ ID NO:2;
(2) an amino acid sequence consisting of amino acids 37-597 of SEQ ID NO:2;
(3) the amino acid sequence of SEQ ID NO:6; and
(4) an amino acid sequence comprising amino acids 4-564 of SEQ ID NO:6; and
(iii) the immunogenic TERT polypeptide comprises an amino acid sequence selected from the group consisting of:
(1) the amino acid sequence of SEQ ID NO:10;
(2) the amino acid sequence of SEQ ID NO:12;
(3) the amino acid sequence of SEQ ID NO:14;
(4) an amino acid sequence comprising amino acids 2-892 of SEQ ID NO:10;
(5) an amino acid sequence comprising amino acids 4-591 of SEQ ID NO:12; and
(6) an amino acid sequence comprising amino acids 3-789 of SEQ ID NO:14.

27. The multi-antigen construct of claim 19, wherein in formula (VIII): TAA1 is a nucleotide sequence encoding an immunogenic MUC1 polypeptide, TAA2 is a nucleotide sequence encoding an immunogenic MSLN polypeptide, and TAA3 is a nucleotide sequence encoding an immunogenic TERT polypeptide.

28. The multi-antigen construct of claim 27, wherein the immunogenic TERT polypeptide comprises an amino acid sequence selected from the group consisting of:
(1) the amino acid sequence of SEQ ID NO:10;
(2) the amino acid sequence of SEQ ID NO:12;
(3) the amino acid sequence of SEQ ID NO:14;
(4) an amino acid sequence comprising amino acids 2-892 of SEQ ID NO:10;
(5) an amino acid sequence comprising amino acids 4-591 of SEQ ID NO:12; and
(6) an amino acid sequence comprising amino acids 3-789 of SEQ ID NO:14.

29. The multi-antigen construct of claim 27, wherein the immunogenic MSLN polypeptide comprises an amino acid sequence selected from the group consisting of:
(1) an amino acid sequence comprising amino acids 37-597 of SEQ ID NO:2;
(2) an amino acid sequence consisting of amino acids 37-597 of SEQ ID NO:2;
(3) the amino acid sequence of SEQ ID NO:6; and
(4) an amino acid sequence comprising amino acids 4-564 of SEQ ID NO:6.

30. The multi-antigen construct of claim 28, wherein the immunogenic MSLN polypeptide comprises an amino acid sequence selected from the group consisting of:
(1) an amino acid sequence comprising amino acids 37-597 of SEQ ID NO:2;
(2) an amino acid sequence consisting of amino acids 37-597 of SEQ ID NO:2;
(3) the amino acid sequence of SEQ ID NO:6; and
(4) an amino acid sequence comprising amino acids 4-564 of SEQ ID NO:6.

31. The multi-antigen construct of claim 19, wherein the nucleotide sequence encoding the immunogenic MUC1 polypeptide is selected from the group consisting of:
(i) the nucleotide sequence of SEQ ID NO:7;
(ii) a nucleotide sequence comprising nucleotides 10-1611 of SEQ ID NO:7;
(iii) the nucleotide sequence of SEQ ID NO:15;
(iv) a nucleotide sequence comprising nucleotides 10-1551 of SEQ ID NO:15; and
(v) a degenerate variant of any of the nucleotide sequences (i)-(iv).

32. The multi-antigen construct of claim 19, wherein the nucleotide sequence encoding the immunogenic MSLN polypeptide is selected from the group consisting of:
(i) the nucleotide sequence of SEQ ID NO:5;
(ii) a nucleotide sequence comprising nucleotides 10-1692 of SEQ ID NO:5; and
(iii) a degenerate variant of (1) the nucleotide sequence of SEQ ID NO:5 or (2) a nucleotide sequence comprising nucleotides 10-1692 of SEQ ID NO:5.

33. The multi-antigen construct of claim 19, wherein the nucleotide sequence encoding the immunogenic TERT polypeptide is selected from the group consisting of:
(i) the nucleotide sequence of SEQ ID NO:9;
(ii) a nucleotide sequence comprising nucleotides 4-2679 of SEQ ID NO:9;
(iii) the nucleotide sequence of SEQ ID NO:11;
(iv) a nucleotide sequence comprising nucleotides 10-1782 of SEQ ID NO:11;
(v) the nucleotide sequence of SEQ ID NO:13;
(vi) a nucleotide sequence comprising nucleotides 7-2373 of SEQ ID NO:13; and (vii) a degenerate variant of any of the nucleotide sequences (i)-(vi).

34. The multi-antigen construct of claim 31, wherein the nucleotide sequence encoding the immunogenic MSLN polypeptide is selected from the group consisting of:
   (i) the nucleotide sequence of SEQ ID NO:5;
   (ii) a nucleotide sequence comprising nucleotides 10-1692 of SEQ ID NO:5; and
   (iii) a degenerate variant of (1) the nucleotide sequence of SEQ ID NO:5 or (2) a nucleotide sequence comprising nucleotides 10-1692 of SEQ ID NO:5.

35. The multi-antigen construct of claim 31, wherein the nucleotide sequence encoding the immunogenic TERT polypeptide is selected from the group consisting of:
   (i) the nucleotide sequence of SEQ ID NO:9;
   (ii) a nucleotide sequence comprising nucleotides 4-2679 of SEQ ID NO:9;
   (iii) the nucleotide sequence of SEQ ID NO:11;
   (iv) a nucleotide sequence comprising nucleotides 10-1782 of SEQ ID NO:11;
   (v) the nucleotide sequence of SEQ ID NO:13;
   (vi) a nucleotide sequence comprising nucleotides 7-2373 of SEQ ID NO:13; and
   (vii) a degenerate variant of any of the nucleotide sequences (i)-(vi).

36. The multi-antigen construct of claim 34, wherein the nucleotide sequence encoding the immunogenic TERT polypeptide is selected from the group consisting of:
   (i) the nucleotide sequence of SEQ ID NO:9;
   (ii) a nucleotide sequence comprising nucleotides 4-2679 of SEQ ID NO:9;
   (iii) the nucleotide sequence of SEQ ID NO:11;
   (iv) a nucleotide sequence comprising nucleotides 10-1782 of SEQ ID NO:11;
   (v) the nucleotide sequence of SEQ ID NO:13;
   (vi) a nucleotide sequence comprising nucleotides 7-2373 of SEQ ID NO:13; and
   (vii) a degenerate variant of any of the nucleotide sequences (i)-(vi).

37. The multi-antigen construct of claim 27, wherein:
   (i) the amino acid sequence of the immunogenic MUC1 polypeptide comprises amino acids 4-537 of SEQ ID NO:8;
   (ii) the amino acid sequence of the immunogenic MSLN polypeptide comprises amino acids 4-564 of SEQ ID NO:6; and
   (iii) the amino acid sequence of the immunogenic TERT polypeptide comprises amino acids 2-892 of SEQ ID NO:10.

38. The multi-antigen construct of claim 27, wherein:
   (i) the nucleotide sequence encoding the immunogenic MSLN polypeptide comprises nucleotides 10-1692 of SEQ ID NO:5;
   (ii) the nucleotide sequence encoding the immunogenic MUC1 polypeptide comprises nucleotides 10-1611 of SEQ ID NO:7; and
   (iii) the nucleotide sequence encoding the immunogenic TERT polypeptide comprises nucleotides 4-2679 of SEQ ID NO:9.

39. A multi-antigen construct, comprising: (a) at least one nucleotide sequence encoding an immunogenic mucin 1 (MUC1) polypeptide; (b) at least one nucleotide sequence encoding an immunogenic mesothelin (MSLN) polypeptide; and (c) at least one nucleotide sequence encoding an immunogenic telomerase reverse transcriptase (TERT) polypeptide, wherein:
   (i) the amino acid sequence of the immunogenic MSLN polypeptide comprises amino acids 4-564 of SEQ ID NO:6;
   (ii) the amino acid sequence of the immunogenic MUC1 polypeptide comprises amino acids 4-537 of SEQ ID NO:8; and
   (iii) the amino acid sequence of the immunogenic TERT polypeptide comprises amino acids 2-892 of SEQ ID NO:10.

40. A multi-antigen construct, comprising: (a) at least one nucleotide sequence encoding an immunogenic mucin 1 (MUC1) polypeptide; (b) at least one nucleotide sequence encoding an immunogenic mesothelin (MSLN) polypeptide; and (c) at least one nucleotide sequence encoding an immunogenic telomerase reverse transcriptase (TERT) polypeptide, wherein:
   (i) the nucleotide sequence encoding the immunogenic MSLN polypeptide comprises nucleotides 10-1692 of SEQ ID NO:5;
   (ii) the nucleotide sequence encoding the immunogenic MUC1 polypeptide comprises nucleotides 10-1611 of SEQ ID NO:7; and
   (iii) the nucleotide sequence encoding the immunogenic TERT polypeptide comprises nucleotides 4-2679 of SEQ ID NO:9.

41. The multi-antigen construct of claim 19, wherein:
   (i) the amino acid sequence of the immunogenic MSLN polypeptide comprises amino acids 4-564 of SEQ ID NO:6;
   (ii) the amino acid sequence of the immunogenic MUC1 polypeptide comprises amino acids 4-537 of SEQ ID NO:8; and
   (iii) the amino acid sequence of the immunogenic TERT polypeptide comprises amino acids 2-892 of SEQ ID NO:10.

42. The multi-antigen construct of claim 19, wherein:
   (i) the nucleotide sequence encoding the immunogenic MSLN polypeptide comprises nucleotides 10-1692 of SEQ ID NO:5;
   (ii) the nucleotide sequence encoding the immunogenic MUC1 polypeptide comprises nucleotides 10-1611 of SEQ ID NO:7; and
   (iii) the nucleotide sequence encoding the immunogenic TERT polypeptide comprises nucleotides 4-2679 of SEQ ID NO:9.

* * * * *